United States Patent 10,724,096 (METHODS AND COMPOSITIONS FOR INHIBITING AND TREATING NEUROLOGICAL CONDITIONS) - sequence listing, part 23

SEQ ID NO: 239 - DNA, 180009 bp, Homo sapiens
gccgggctcctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgaggtagcgcgagcgctttctctctctctcccctgcccttccctctgcgtccgtcgtcggcccccgaggcgcctgctccgcgcctttgtgcccgcggtccctggccccgtcgcaccctgcgggcgggggtcagcgggctctgccgctctcttgggagacgcggcgctgcggcgggaacggcgcacgctgtaggttgcggagggtggtcgtgactccgcagtggcttcgggggtggcgggagggaagaagggcttgtaaactaagttgctcttactttgccccatgcctctcgtacctgtgggcagagtcgaatctcggctgtcctcgtgttcacccacagcccctccattcctctggcccacagctgtttcctggccccctggaaagacacggtgtggcttcctccgggcaggaaagcggagggagaacaatggggcgtcctggggagtggggttcaggtgcggtgtgccccggcggcggcgggggaggaggggcccgggacgctgtgggcctccctgcgcgtgcagctgcgctcgcctcctttgttccgccgcagcggagggggttgccctgggtctcgtttcctgcccgggatgggattgattcacggtcccagagagggaaggggaagggggcggggctggaatggaaaccagattagagacgggagctacgaagggtggtggggccgggaagagagttggggagagggttgggagagggtgatgagagcgcgctggagaggtaactacaaacacacaacattttgttcaagggccatgtgagtttctagagcttatttgtagtgctttgttcaggcttcggcccagcgtttattgctgcaacaagttgtgtgcttcttgagtttctaggcgttcccaatgttagattgctcaaagcaaatcttcttagttacagtgaaagaagcccccccccctttttttttgagatttgaaaaaattttgctatgaactatggtattggtgtgtatgtgtgtgcctctgggtctgtgtgtgtagctagtggatattggctggaatgggtaggagacaaattttatagaatcaattttgacgtaaaattgttttatagtataatatagtacaacagttttccaggactgtttgagggcagaaaccaccagaaaattagacattgctataaataaatgaatcagactatgtaacacaattgaaaaacccttttacagtctgtcccaggaaacacaccacacacaccagcgtttggggtttgaactgaggagccctggcattgaagtgttctgtgctttcactctctgtgtgaggatcgtttagaggtggtagaattaaatgtaatgtgtcagacatttgttaagtgacctttcctagattggaatcgagactcgccaaaggattggctgacctagggagggagctatgggggattgaatgatgtgtgttttttgaatggggtattccaagcaaaactgttttgggaggaggctgacatttccaggcattcatggtttgtgcctgtgggacactggtgggaggattcccaaagtcggactgaaggttagcattactgtggtgataatttaggagacattctgttgtagtagtctggctgcagacagggctgggaagtggcccagagctgcctctttgacaagctgagggtccgccattaaaccacccctttggccatttattttgagatgaaccaagtttgaaagcctcttaaccttagaaggctaattaggagcttgctgtgggggaaaaaaatatctcctgcccactaagtggtaatggaaaagagctgtataagctactgctgagggtttgtctttttcgtgggggatgtggtcaaattttcaggccaggctgaaaagcactgggagttgtcctcaggagccattatgatgtgaagttgaaatgggatggtgtccaactgtcaagctgtttgtcattagaactaacacactgcctggcaaaacgttgtgctagggcagctaacagagggagactttttgttgttgttgtcttaccattttggacttttcacttatgctgtgaattgttttataaaatacaacacgattgaattcctctcaagtactcattgttctatacattaacaaaatgtaaagcatctgaacattgctgctactggagatgtggacagatagcagaatcctaagtggctggtctctggtctctggcctctggccgttctggtggatgcctgattgtgtgataaggctggcaacaggctgtatccccttcccaggatgaatcatcactttgtcaagcctggagttaaagactaacttaccctgattgctgcacagttatgcaaagcaaggaggaacgtctgacatcatggggaagaagagggagtgaggtgagtgggtggtgtttggctaagaagggatcttcagcatgtagcatccatgtttttagcatttgtcctcctttgggtaagattgtcttctacctcccttctactgttttcaatagctgaacatttggattttaattaaatagcctaacaataattatagctatcatttagtatgtgttcattacatgccaagaattttacatacattactatattcatcatcacaacaacttgataaagtgggtgttatcttcattttccagtggaaactgaggcctggaggagttaagtaacttgccccttacaccgtacagatgctcctagatttacaatggggttatgtcctgataaacccatcataagttgaaaatattgtaagttgaaaatgcatttaatacacttaatctaccgaaccttaaatgtgtccagaacagtcacattagcctacagttgggcaaaatcgtctggtaacacagtccactgtagagtattggttgttcatccttgtgatggtgtagctgactgggagctgcggctcgctgccactgcccagcattgtgatggggtatcgtactacatgtggctagccccagaaaacatcacaattcaaaattctaagtatgatttccactgaatgcctatcatttttgcaccattatagagtaaaaaaatcctaagttgaaccattgtaaattgaggaccctctgtgcttgtgtagctaactactaagtggtggaagtgcgattggggatcccaaagtccatactctttaggtatatactgtatggtatgatgtattttaataataacaacagtttgattatctagttggttagcccctggcagatgtcaaattactttcacgtctattattgtagttgattcttccaaaaaccactgtgagataggtttggaagcccaggttaggacattacaactcttagaactgtattgctaaagagctgtatgttatggcctgtatgaataagctgtaagtgaatgaaactttacttttaaaaagttaggttgccaacatttaaaaataagttcttttttcgaaacatttaaaagtggtagaacagagtagatcttatattgcactcaaggcttttatgtttattgaaatccattttaagccctttttatcttacagcctttaatagaacattgcactttgcttcttaactgagacccgatgccagagtgtctttttaagaagagaaataaggagggaaggaatgtgcttataaagaggaagtgggacatcagaattggaaacactcgcagcagcaggccatagatttttcccagcacatgctttttgtcctggcagtagccttttacagaaggcattcttccttagggaagtgtcaagggtctttctttacagtatcctctgagatcatcaaatttctgagctctgtgggaacactcattccacatgatttttgtgctcatcccttccccacaggggaagtgaactagtttaggcatctgcatgaaaagggaatagcagtggtatctgtccttagggtggcactgagagtggcactgggcaagaggtaccagactttgacaccaagtacaggagcagactggagtttaacacttggcatcatggattgtttgtggattcctcagaatgctcctgggcaaatggaaaagtcaatattaggtttttgttgttgttgttgtttctaagataagaatttgaagactggaagttctgccttgtttatttatttcaagctaggacaccatttggggtcttcaagttctgtggtataggtgagagtaactttagtctcctcaggctatgaaattctcctccactggctattttagacttttgcctctggaggagaggcagacacatggtttgctaaactctaacaggtgagcaccttccaacttaccataagcagcatagaggaggaaaaaggatgcttcccagcattacactcttacagcctttggtaggtctttgcagttgtcagcctcttcctcatcagttcatattttattaagcacacaggtcatgcaagacaatgcattagacccattttaaaaggaagaaaggaaatccattgtgctttcagggtcgttgtagcagggcaggtggatgcatcccaagagtggatgttggtgaaatgaagaaaatggctatgacagctgtagtgaccaagaccaggggaacacttgcttttgagacaaaagctgagaacaaacagaagcaagagagtggaagaaaactgaacacaggtgccagcttctctgacttaggttttatttcctccaatctccaatgatgtgaaagcgttcaggttcagaaccctgactgaggtccaaaaaatgatatataaactaccattctatgcgagaaggtttgaatagcagtgtcttccctggtgcatggcaggtccttggtacctccgccaactctcttctctacacacctgccagcatcccttcctcatcctgtgttcaatgtggctgtcaactaaggctgttaatagacttcaggcatatttgcattttaaaaggctcttgtggacaagacatgccaaatctccaaagaatgagtcattcacattgagttatatgatattattcatgctactgtttattaagtattgggtgcttgctttgtgctaggcctcatgctgggtactttctgtaggttgatttccttctcatcactatcccttagtaggaggtatttgtagatgagggaattgagtcactagcccagaggtcaagcctcaaagacccctttgctttccagaacaacgaagtgccaccaggtagagtgtactgtgaagctttgaatgagtactgtggagctttgggcaaaaactttgattctttgggtgagtactttgatgctttggtcacttttaaggagttctttttaaggagttagagggagagcccagctgttgtccctctccttcctggcttgtttcctttgtcacctgaagtcaggattcctgtaggtgtccttggctggtccaaagctaggagaattggttgaactgcttctcagtttatccttttctgggtgttttggcttcccagtcctgcgtcattctccttccccagctgagggagacaagattcagcctgctagtgagagactgaatagccagtcccttttcttacccccttgctggccatgcctttatcttcaggaatagattgtcatctgggagtttcagggcgtttgtctgatctctggtctccagtctgcctgcgagcagcatgccacagggcatccagtcctggagctcgctcagatctttgatgtgtgagaataagcggtgtggatgccattgcagagctgggttttgggaagagagttggggtgaaatttgtactcttccaagataggcagttttataaatagcagaaaagtaaaaattgacattcttcttttgcttatcagataagcacctgataagtttctgaaaatgcaaggggcctgtctttccttgatagcttaagagaggcttaagaggaaaccaaatctctgccttccggggactttcagtccaattcttcctggactcaagatgctttaagattgcacagatggcttaagttcgctgtgttaaaatgaaaatatagtaatgtatttcagaattgtacattacaggtttttaaatttgtttaaaaaaagaatgcaatatctttaaagactttttagaaaattgaattgaaaggacagtggaacagattattagttatcgacattataatacatttacacgtcatttgcctacttaattttcactggttacatgaaagcattttcacattgcaaccacaacaaaaagctcccccaaaatacacaaagaatcttaattgcaagattcctgctggtcccacttaacattttccagtgtacaccttctctctccatcattgctgctttgctttacattttatattagatcctgaattgctatttgtgatgttcagattgcaaatatactagcttcctaactgatcattttttcccttaaaagtacttcagagtgattggtcactgttttattcattttagacccacagtctaaatgctttaaggaaaagcttaattttcatagacattgggcctatgccaatttgcatggcttgttatttttgtgatcctcatattatctgcttctagtcataatcggtagatcacagttttgagctacccctgatatagtgagccatctatgaaaaagttctcgcttgcctgaaattttcaaagtgttgagagctattcataaaaatgtatgaactgccacgttggtcaggttcagggcttatttgccgtagtactctgcaggtattctgtgacattcaggaaggaaaatagagttagactcctgatgtcagctttgtaaaggttcatagatgtctcttgagtatctgtaattacatgatctcttaaaaacctcttatccatgtactgaaattcatcttgaattgtttatttttatcctgcattcacacaattcacactttaaagatagaacttgattatattggtatttttatttcaaattttcaatttttggaatggcagaatgttgctattgaaaagtgtcttaaaggtcaccactgtaaccccttcattgtgcttgagacctgctcagctcctaaatttaacaggggacggatctgagaaactgactccaagttgtaacctcttgcttagttttctttctagggagatatccgtctctccaaacctgtcgaaatctaaatttattacctcttacctaatacttggtcccctgtggacttcacttcactgtttgtgctaatagccttttcatcaccatcttgactttggattctagagcatcacctacttccccattttctgtgacccttacattcctcctgtcagtcactatgtctgatttattgttctcccctatcttttgccctttgcaaatcctcaagccctcattctggttcagacctttaaaaggctgagttactggagtatagtgttacccaaagtgagttgttccataaaaaattagtaagttggaaaaaaaaacaaaaaacaaaaaaataccctacccataaagttggtaaatgttcctgtaaaaagggttccttggccaggtacatgttagaatagctggttaagtttctttgcagaaagacttctcctggccttcatttgtgactgtgtactgtgaattcccaagagaaagatacagtattcacttgtcccaacttatgtcaccattgtaccacgttttggggggatcatttcgtagataacactgctatagtcacttcactgtagctttttaggttctgtcactgcctggcttcctgtgggaatgtgcattccatgtgagccgtacttggttcactctcaactgtgtcttgtgcttttaccttgttgttctggatcgttccttccccccagaagcccctctcccctatcacactggcacatctttcagtgcccagctttgtgcctgtcttctctgtcagttttcccagactcaggttgcgcttgttcttctgaacttaactgtttcacaacttaaaaaaaaaaaagaaaatatttgaagcacaatgaaatgttgaaagtaaccttacacattcatatggttaaattattggaattcccacaaaattccattttccatatttgcgtcagttgacacatcacatgcacatcacattctcctctgtttccccccacaggttagcttgcacatatgttcaacaagcttgttgcttgtggggcttttttctttaattttgtgttactgaaattgtgttgcatttaaatagaaattcagggagaattgacatctttatggtttaatggcttcccatccacaaacctcataagcttctttaatagttcttttatgtccttcaatgaaatttttatcattttgtatgtaaaactctttcataccgcttgttagatttgtgccaaggtgcttcatggtttctgtggtcattttgaatgaatgatttagtacatttctggttagtgttgctggtgtacaagaaagggattgattttgtatttgtttataaatagttcttgattgatcaagttcacatctaaacctgtgtttgctgtgggagcctgcagttgggtggcttttccaatacagcataaaataacttagcctttattgaaaatgtcataattcactttatttttatttatttatttattttttgagacagagtttcgctcttgctgcccaggctggagtgcagtggcataatcttggctcactgcaacctccacctcccaggttcaagcaattctcctgcctcagcctcccgagtagctgggattacaggcatgcaaccaccacgcctggctaattttgtatttttggcagagatggggtttctccatgttgagactgatctcgaactcctgacctcaggtgatccacccaccttggcctcccaaagtgctaggattacaggcgtgagccaccgcgcccggcctcttttttttttttagagacaagtctggctctgttgcataggctggaatgcaatggcatgatcgtagctcggtgcagcctcatactcctggactcaaatgagcctcccacctcagcttcccaagtaactaggactattggtgtgcgcctccatgcccaactaatttttaaattttttgtagaggtgatgtctcattggtcccaggctcctggcctcaatcagttctcctgccttggtttcccaagtgctgggattacaggtgtaagtcaccacacctgacctaatttaaaaattatatgcagtacttttagaagtaaggaaggggtgacttttagttatttaatgtgttcatttattaactcatcaaatgtttaggtgcctagtatgtttcaggcaccgtactaggtactgtgtttttgtttttgtttttgttttagagacagggtctctctttgttgctcaggccggagtacagtggtgtgaacatagctcactgcaggatcgaactcctgggcacaagtgatcctcctgtctccacctcccaagcagctaggactacaggcagcatctccacaccccactcattttttacatttttttgtggagacggggtctttctatgttgcccaggctggtcttgaactcctggcctcaagtgatcctccctcctcagcctcttgaagtgttaggattacaggtatgaggcactacacccatcctgtactgaatctttaatgttgaacaaaacagatgtggtttctgctctcatgaatgtgaaggggaagagacattgtggaaatggacacggataaatatgtattcgtggattagcatcgatactgtgaaggaaaaggacagggggctgtgagaaacagaaaggcggagagagggaaatttagattggggtacaaggagagcctgacttaggaaataaacattcacacagctgcctgaaggatgagttggtgttaaagaatgaggaggatggaagaactttgtaggcaataaaaagaggctcagaagccccaaggtgggactctactctgaatgacacaaagatgggaattttagtgactgatgacttaaatcaagttattaattcttagtaaattatcataatagtggtatttaacagtgttttacacactattatgacaaagtgaaggtatttattttttatcagtatatcctcatcctgccaagtgaagctggctagattcagagagctgcctctatggtgaggcttgaatggggccactgcccacacccctaccccctctgcattttgagtattgccactgctgctgccattgggtcctggcatctgctggacacgagcgtcctgctcagcaattttctcctgagctctgcactaatagacggggtcctttaaggtcaggtcaggtcaggtcggaagaagactgctctgcccttcctgggaggggtggtgagcagggccttctatgttttttccagtgtctcagccttctccactctccctccttcactgtctcttaaacacacactgagggctcaggcatgacaatgggatgggatccaaactgagttacacacctgcctagaatctgtgctctgtttggtcattgaagcattgctctggggcaggcatgactgagcttagttgagataagtcctctgtatagtgaaaagctatgtggtgcagtggttatgggctgggctctggagacaatactggtttttgaaacttgactcttctccttagtagcccccggaccctgggcttgtagcttaaacggtctgcctccattttctcatctgcgcaatgtgggtaattttgcagagctgccttctttgggttatagtaaggattaaatgaatcaacacatgtgcagctcctagaacagtgtcaggcacagagcaagcacttggtgtagatgttagttactactattcagcctttcctgcaatgctttcctggggttcctcctcccccacaccagatatttaaatctgtttgaatcctagcagtgcacataatttaggatttcatacgagggacccctttggaaaatatggggagaaagatggcaaaaaaagaaaccaaaatgttaagtgattgtgttacgataatagattggggtgacttttacttttaactctctattttctaaatcttctataacctggttatgttacctctgtactaataatataataaaattatttgaagaaagaaaagtcaggctggcggtctccagttggtttgctaaaaagggacaggagagagtgagaagccaggggtaggcctgctctagtggcattcacaggtgaagtaccttcccatttgtgcttatagttgcagaaactaggtaacggtgttgaatagtctttagcagaagtatccccaaaagttagaagatggggctattccttgtgaatcccccttttctgtgaattttttttttaatctgtcattattttccctttttgtttgttctgtgctcccttagtggtcctcttgccatatgtctctcattcagtcccctcttcctcccccttccccttgaaagtctctccttttaatccatcttctttacctactgtcatgcagaaattatgcacccatttattcaattcaaaataaagcatcagttttatttttattgtcaaaataagtaaatataacttttcactctcagaaatctaaatgaagttgccctttacttacttacacctaaattaattgattagttaatttatttgctgacaaattaatgaactctgggggtctgtgacctcctaaaagcaccaggaatcttggaagattgggtggctgcaaggaagggaagattgaggggatgttgaagttaaatttttcctctttgcctattttgcatagggttatctgtgttgctgccattttggtatatgtcagaatttttgaacttttccaacagaattctggaaaattaccaaaatacatttttacaaagaaaccatgccaaatctgacaaatttcttcaaaagcccattgattttaatcactgaaaagttcagcgaactttccagcttttctttcatgctgctctttttatgtaattgtgggtggagaaatggactttcctgcaaagtgtgtttatctacaggaatttattcttggcagtggcattttataagtatcttaaaaataatgctgacatagatttgaaagaaggtagtgggttacagtaatgttacctgctatcagctgaagagctgtttacatgaggaatattgctaatttaatgatgctacacaattgagtgtaaaatctagtggaggacatttaaataaacggaagtaaggtgatgcctttctgtaccttattccacaatttaggtattttatcttcaatgacaaatgcctaatttgaacatatcataaatatttatgatagttctttttctgctttaaggaagtctgggacaattacagtaaaatctagttttataaaatgtgtatacctagacttagcattggttttttcaaaagaagacatcataggaattttttaaattagaaccaatatatgtatcgcttaatgatgggtatacattctgtgaagtgtgtcatcgggcaattttgtcattgcgcaaacaccacaaagtggacttaacacaaacttagatgggacagacaaccgtatacaggtacagccaacacaagtatagccaattgctcctagtctacaaacctgtacagacgtgttaccatactgaatattgtaggcaattataacacagtagtatttgtgtatctaaacaaagagaaggaatagtaaagatatggtataaaagataaaaaatgttacacctctctagggcacttatgaatagagcttgcaagaccagaagttgctctgggggagtcagtgagtgatgggtgaatgtgagggcctaggacgttactgtacactgctgtagactttataaacactgtacacttaggctaccctaaatttataaaaacacaaagtaattgcatcatgacgtcactagtcgataggaatttttcaactgcattttaaacttatgggacctccattatatgtgtggtctgttgttgacagaaacagatgtggtgtgtgactatatcccctttttgagtagggcagcggttatagctgcttatttgcttttgtcacagagctacatgatgttggcatgaccttgtatctccacttcatacacactaatactgtggaggaggatcaagtcgttgggtttagcctaggcatgccaagggtatggcatgagcatggaacacataatgctagaactgccagcccagtcttaatacttagcactggttgccagtttaaaaaacaatacaaaggtataggtaaaatgttaaaggaaacttgtactaatttatgtcctttgaagtgacctttttgtgtctcatggaccctgggctgtagtacctgactatcttctgcaactcggatggagaaaatgccccttccttacctggcaggcagtgagccaggctggacattagatacatagtcgacttcacctactctgtgatttagcttccagctttaccgtttgctgtcttggcagcagcttgtgcatggtgaacttttctgactagaacagttaataacccccacagatgttgggagcccagttttgcagctgttgatatgtccagttggatttcttgaaagaattaatcaattttgaagatctcatgccgtgggctgcaagcataataggatttagggggaaactttattttatgggagtttgagttggtattgcaacagatgtagcaggaggttgaacagcagctgaagggatgcaggaaaatggagtttaaaaagatgtttgtgggcctaccactctaaaagtgtcaactgtggtcatttctgaatattcttttccaggctttttatgtgaatgttttaaaatgtgatcataatcatagagtacatacattttctatattgctacatagtatttgaaataaattttatagttgtgtattattccattgagtaccatcattttctgcagcatccctttatttttgggcatttgtattccttctgccactttgctgttgtgaataatactgtgatgagcctttttgtacctataaccttttctatattttgaatgattttctgacagtagatattgagaacgaggtgattgggtcaaagattgctgtgaactctttgatgtaatcaggtaatggatggagtgacttggttggtggggcagaaagagttggagtctgggataactccctagtttctggcttgtgtgatgttgggaatggtttgcatagacagggccacaagtgaggggttcattttgggatgtggggcattcaggcagtgagggagcttcagggactgttgaaatgcaaggtccggagcttagggaaaagccagggcctggggttcagatgaggggatcatgggcagctacgtgtggtggaagctgtggataatgttaggattgcttagagggtagagtgagaagaggaaggcggaggatagaactctgggaacatcattctgtgacaagtagagaatggagaagcactaaggaaaataaggagtgtccggaggtgggatgtggacagccagggtttcctttcttttcaagagcttactttggttaaaataagattgagtgggtagctatccctgtagagcctgggggcagatttattttggagggtataatattacttttttcccagataggctttttttttttttgaattaaagctatatagaagttaaggttattctatttggtgctgagtggggagccttatatgcatggtactggggtcaggattgacttgtatgtatgtgttatttaaactgttttggttgttttgggcttctggtgtgtatatgtttacataacattggttgttttggggtttctggtgtatatgtctttacacagtgttttagtagtctattgaaatatatcaatatcatttttacacaaaagaacatattttttttgaagagagtgaatgtcagatttctaaaagtatgtcaatcatgaatggatttaccatttagctacttacaatagaagcacccagatttttctgggagcctttgcttttttcaagagagtgatattccttttcagagaaacatttgtctgtgttgacaattttaaagaagtatgtaattttaaattatgaaactcaaatttagtttttaatagtaatttctgtgtttattctttctatctttaagagccaagttatagaatgacatgtgaccttgtactcttgactctatgtctggttgtggatttgaagtgttatttttgtgctttcctaaatgacttaagcacttatgactatatatttggatcagaataaatatggtagttggatatacttttgaaaagccaaccagatttttaacctggtaataccatagtactattcattcttatgattgtccagactcacagctttagaaaacagtctaagcttttattgacttccagacttgctggatttgttggtgttctctttttctctgtaaagtggatcagccgatgccatagatacactaatgctccaagctagagggctaccctgtagtgtgctcttgagtttcttttcccaccagttgagaagaatgcttctccagacctgactgtgttaattcccagacctgcgtgtgcccggtgtacttattatagtttaatacaatgattttaaacatgtgtgccaaaagaattgttgtttctatgaaaattcatttgaattctttggaaatcacctgataagaatgaatttccataaatgactgcagctaatttaggagtggctgagataagtaaaaaatttgggggatcataaaataaaagtatcctcactgatattatcagtcattcatgattggtgggttaagttgtgattatgtaaaactcgataatcgtactggctcaaagcagtaacccatgttcacactgtgtgtccgttgtggatcagatggggactctgctccatttgtccttaaccttactccagaacacagtctgatggggcagtaccttctggaacgttgctggtccctgtggcagaggggacgcctgctgcaaaggtcttattggctatatgcctgaattcagcaaggcgggacgtagagaggggtatggggcatttgtaaagggtaatgaggtctaccgcacttcactttccagggctctttagaacctcactgttctttaaataaattggacttggaggatgatgccttgggatggtttatagaagaaagaccattgagtacaacagtggacatatactcaaagaaaaggctccagcactataacaaaagattgacaataaatgtatatttgtagagcttcatttaaaatgacttgtttaggtatgtatcattttttatgacttccaaatttaactgacttaaaaaaaaataagccaaattgtcaatccttatgcatttggataagagaacctctactttagtcttaaacgctcctgtctctcttccacctctgtcaaattagtttcccaccttttatgatagactcatctgtgatttcccttggcacatctccttttcatttccattagcattatcctaattcttgttcctcaactactagattggggccccagatgaattccttgatatactgtcttgtatagggcctgtatgcagtgagaaaaaggcactctttggggcagacacaatcccacaggagctcaactttattttagtcaccttattctgccgccccccctcctccccagctggcccacttttatgcagtacacaaactgaacaactgcacagagcagtcctcctccctgcatttagtcgctttgccaacaaattcagactgcccatcctctgcttaagcctcctttaaatttgttgtctctattgtgctcaaaatcattttggtggctccctgtcatctgtatgtagtggctgacctcagttttatcttccatgggaccatcaccagtgactctgagccttagttgttgccatcttgatgtgtgacataagtaatgactgtagcacagatgcgctggttaggctatgtaatgcttctctctccccgcccacccattcccaccactctaacacctgtgagctccttaggtctgactcctagtctagccttggcttacctttcatcccagcttcattgttcatcaggctcctataccggccgtcctctgctaccattctgccaggtcaccgtcttctgaatatgttttttattcttgctttaaacttcttttctgcttaatcacatccaactcacctttcatggtcgagtttcacctcttcagctatccttctgtgattctcctgctgtatgatagtagctgtacctctaaacagaaatgttcatctctatattcctccttttgaggtgaatcgcctgccctatatgaacatattatactggttatcttactcttaagtattctttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttggtaagcagttttaatttctaaaccagaggggccttataattttgtcatttaaaaagaactctagtttttctacccacctattgagagacagacgtaagggtagaaatgtaaattttaagttttgatgatttataatataataatgtattttgaaagccccttttttgataaactacttgtagaaggaagttaacttttcttaatcgggtttctacaaggtagttcactattgtatgttttatttcttaccaaaacttttcttgggaaaatttgttttattgctccatacgtggtcaaggtaattaactttaaaaatggattttcctatagctttacaggttattaacatgtgctgtattcaaggagaaaaaactgtgtgtgggggtgttgtcagtatgtctccttatataaatatatgaagtaactgctgtatcctgtagaatatttggaaattagcagaactattcaaatttagttaacatttataaatgtgaattttataaacaaaaatttcagtaaacattttatttgtgacttaaaaatgattagttatggcatgtcttataggttgatttgtttgtagtgtcttttgttcttcataaatacttcagaatgtatttaaggatatgtaagaattatggtgcctttgattttaaaaggaatgcttccaacattagaaaaaccagaaattgacctagaaaatgtttccaaattctaatataattgttgattttaatcagtgtaggtgaaataacccactgcagcagtttagctattttctttaaaaattatttctcaatttacattatcagtgtcttttttggaacatcttagctatttttgtttgatcaattctcaactaataaacattcatgaaatcctaatgtaaatgtataaatatctctgcctttgtttacatagtttattggactttattttagtggattactgcttgaggaagcttctgaatttttattattctaaaaaacttttttaaaccttgagtatgaaggcattaccaaagcttcactgttgagtgatgcatattttttcccctcctttacatgtagattacttaatttgtaatctttagacttttttttttttgctttcctaactaggtgaatttttaaaagtagccagttccattttgtagctaaccatgtattgtaaacacacagaaaacatgctcaaatgtgccttgatggcctaacttacctggttattctgtgcatctttctgtgctgtgtatggttgcactcttaatatattttattttggttatgagatcagaataaagagagctgctttcctttgcctctgagtaatgtcactgagagagattcttgtggtctggcatttgctggctttttggtttttaacattctctataaccagatctaggatgcatgctcatcccagaatgagcaaactcagtctttccagagttgagccttgtttttttttgttgaatcaacagcgttggaagctgggacaagatcctaggagatgatgtgttatacgctttgtgaggaaactgaggcttgaaggtggcagtgtgcccagtgtctcactgtgagctagctgcagagctgggcctgcaacttggatcttgtggatgttttttccagaaccactgcagtagtcgttgtaacctatgatctgttgcagaatgccaaagctgttgttttctggagggataattttcttccttaacctacaaacaagaatagtgcactaaattcagtacatttctctccattgtcactaaaagagcctgaacgatgggaaggcccctgtttttttttttttttttttaaagaaggccattctgccatagtgtatcccaggctgttttatgtgagtgtctttgttcagaaccaatccggagtggcctccaaaactaatgggtagaggaaaccctatgtgagtgcctaccaggtgcaaatcactgtatttttaattataatgaaggtgtaccttgagtgattgcatgatccgatcaggcataaagagaacagaggaatgaatctacaagtggtgtaagactttgttgaggatcttagcacatggaatgagattgagaccctctgattaataagctgattcatttggaagggaagttggttttcctctggtggctatattcaattcagtaatcaccagtctttcttggcgtctgtgcacccaccaggaacaaatcagagtcgggtgtgccagttatatttgaacagttttacgttcacttaggggttccggggtctcaggtttgccaatctaaacacattgacttcttggaatttttaaaatctgcctcgaaggaacgcattgaaaagtccgtgcgttataattagcatgttcccctgtacagctgagtttgtgtttctggatgtaacagcggtttatagtttttggctgcctcgtccctcaggaatttgtagccttttttcagacgttagctcattaattctccagtcattgtgagctgtatagcatgacgaccggttcccctacagctgggctgcatgctgcccattctggaccttctagggttgtggcaggtggggggtccatgttgagggggtggagagggaggcagggcatgactttcagacccagccttggagtggggtgtgtgctctctgaagttgacctgccctttggcagccattcctgccatgactctgtagagcttcctccgggaaatgactgtagggacagtggtgttggctgcatttcctccttagggtgttaaacctcatgtaagatcaactgcaaatgaggtaactcactaggttagttacctggacacacctgctaggagacaggacagaagagtaggtaagctcttcagggtgagaagaagaaaggggcattggagagggagaaattcatctaatgagtttgctctctcagtcaggctacataacagccctgtggaatagatattgtcatccctgagtttttagattagaaatttgaattccagagatgaattcctttggattccagcctgggtctgtggctccacagcctgtgccgtaccacaatggggtggatcgaaaggatccttggtggtaaactattgctgcaagccttctgtaatatagaagcaaaaactctttgaaaaatggtgcagtgttgtgaagagcttggtgatttaggaattagactgaagggtatatgtaatagaataggtgtgaaagaccattttcagacccgtcagaaaagcttcatcctcgccctggctcttctagaaaccagctggctccaccgccttcttttttaaaggaaggttttgcctgggattctaaggtctctctccttgctctttaattataaacaaaggcacttagaaattttgcccttacgtcacaagtgagagttggtaactggtaatccaaaaccttccatgttgttatagcagccgctgttatttttgactcaatttcttctaattagtctagatggtatattttgtcattctcactttacacagttgggaaaaaacttttttccctctcgtcagtttgcaaattgtaaggttctagatgctgtctttcagtccttaatcactggcctgtgcctgggattgagggtggttgattaagggtatctccttgttgatgacttttattgatgtaaggccagcttttctatactcagacagaaacagaccttgatcttggtggtgcctgtccctctctgcctatgcagagacaaaacctagggtgttaacccttagataaccagaatgttgaattaatagcccctcccactcacagctttttaaggttggagtcaggtatggcaaatgggcttccatttgcttttatccatttgtttgttttcacttcctgtttaaatctattggatttcttcattgcctggtaatttcatgtcctttgtattagccagaatttgaacacaagtcaacaacatactatatggaaattgcccagtagttgtgcctatttcttccataatccaagattttaacaaaagccctcctactagcattccattagacattttcagcagaaagctttagagaaaatgaggtgaggggtttctcaatatatagttggctttcacagtgaatttaaggattggaaaatgagagaattataattggtgaggtaaatgccatgaatagacacaccttatataaatatctttaagcaagtgtgtaggtaggaatgaaaatcagccatcacctaagtctttccacaaatgcatgtcggggcactcactttctccaatgctttagggagccctgcagggcaccccgtgtggttctgtgtggcccaccagccccatcacctttgagaataatgctgcttgagtaaattgtcctatagaatccagttttcacccagtttgcgtttttggttggtaaatactaaggaagtgtcttgtcctttggtttctaactttaatccttcatgaggacattcctggtgtgtcatcgaggctctctgatggtcctttgccagttatgacctggagtggaagggtagcgatgatggaaaccgtcctggacagaagaatgggctgtgcctgtctaatatgcatttatttattcattttctttctacacaccagagccctgtgtgtcagccacgctgttaggcatggggcttgtgcacattgagaacttaaacctcccttctccaggggaagagcagacaaacaaactcacaattgtgagggaagggaagtattttggcatattggtctgattgagctgctgtaacaagataccatggaccgggtggcttaaagaacagacatttatttctcacagttctggaggctgcggagtgggagatcaagttgttggtagattcagtttctggtgagggtcctcttcctggcttgcagatggctgcctttttgatgtgtcttcacactacagagaaagagcgaaccctggtttctttttttcttataaggacaccaatctcttcatgggggcctcaccctcctgactgcatctaaaccaaattactttccaaaggacccacctccaaatatcatcatactgggggctagggcttcaacataatagattttgggaggacgcaagcattcagtccgtaagatttggcttgctcacagcatgtctcctatgaggaatggttattgacactggtttaagttggggggtatttatgtctgacaagaggctcagtggaacctctcgagggcctacagctagaaccactctgggcagcaaaggcagctgttctgtctgcctgccatggtctgtcaccatgcttcattcttctcttcagataggcttcctctggaggagtctgggaaggttcacccgcatgatagctgttccctggatctctatgagctccatgctctgctgcccacagccacctgactgtggtgtctgtgtcctgctggcagatctttggaagctttgtttgggctggtgtatacccaccactcagttagctgtggtctggctgaaggtgctgtggcaggccttggcatctttgtgtgtgtgtaagtggggactgtgcaggggagagattggactaaggagaaaggctgtggaatcatgtgttctctgctaaggaatttcttttttaacttggtaaaatatacataacataaaatctaccattttaaccttttttaagtgtacagtttagtcacattaagtgcactcccactgctgtgccgccatcaccactatctctagagatttttcattatcccaaactaaaactgtagccgttaaatagcacctcctcattactctctcctcccagcccctggtaaccaccattctttttgtctctatgaatttgacttttctgtgtaccttatataagtgggatcgtatatttctactcttgggactggcttatttcacataacttagtgccctcaaggttcgttgatgtagcatgtatcaggatttccttcctttttaaggctgagtaatgttccattttgtgtatgtaccatattttgtttatccattcatccattgatggacacttgggttacttataccctttggctgttgtgaatgatgctgctatgaacatgggtgtaccaacatctgtttgagtgccttctttcacttcttttaggtatatacccagaggtggaatttctcggttacgtagggagtctgtgtttaatttgttggaggctctgctaaagaatcataatgctggctgaaaggcactggagagttattgaagggtttgaagcaggttatgcctaatcagattgtgatttgaaaaagtaacttgggtggtgtgggctggggaaaaggaaagggctggcaaggctgtggtggcgagacaaggcagagagaccccttagaaagctcttgaggggaagggatagaagtgagcttaatcaaggtgatacagtcagtgagacagattggatatgtgggaaggaaggaagagacagggagaagccaaggatgagaacctggatggatcaattgttattttgtggaatttagagggagtaagatttttcttgttttgttttttatattttggtgtgggatgattgatacaaattttggaaatgtgttgagctgttagacacagccaagtggtagagatgattggtaggcaggctgtcgataatatgggttgctaatttggggtaaaggagaaggtaagaataaaggagcagatggccatgcaatttggctgaatttaaaagtggtgggggcattatggatgcagcgccacaatttcagctcctgaggaatgatgtcacattcctaccttgagacaacatatcaaaatttacaaaacaaggaaaggtggccaattcattggttgtaaaaaggagctttcaaaaggattctaataagttcaaaaggatttagaccgaagcataaggatgttgaatttggcttatagtctttttgctcatctatattttctagtttttttctatagtgaacatgtattacttttaattattaaaaagttccttgaaaatttcaaaagtggcctattttcttgacttttctattggaccgtgagttcctagagggtgatgcagggagggggaggtaccacgatgttcactgtgttcttagcactttacaccatgccagcagcacaacaggcctcaatactgtaaaagctggttgaactgaattgaatggaaatttaatctaacccctctcagagagatgagattcggtgctattttaaaagatctaggaaggaaattccagtttttctgactcccttagctcattatattaggtactgaaccacatcctacagacttggctcctcttttgcctttgttttgccatcaggatttgctgagagttactgtgttcatgaaatcttgccacattggctccattttcttacctaaatatgtttctcatgctattcttaaaagcattagtgatcttgttgggagccaagtagctcaattctgtttcctgccctttgttgataatatgtttttggaggaatggatcaaagtggcttgaagccactgtcattgttttgccttctggtctgctgtgaccaaaccaaaggatggcagctgtgaggacgtgcattgttgtacgactcagttgtcaatcggaaatttgcatacttgttttccctttgtatatcactgaatggctaccatgtgcaagaggctgtgcactgtgctttcaggaaataaagatgaataaggcatgattcttgacaccaaagagctgattttctagaaaaggtgctgtcatgcatacatgaccactatacagggaggttaatgagtggaactggagtcagataaaacacacttgttactatgcgaagaagaatccctgtaggtgctgtctctggtgtatattgctaatgctgttatactgctaatgatgttataatatatgtgttttaaatgtcctcatttacaattaccaaagcaatagataactgctttcactaagttttcctgcaagtaactcttttggctttgttttaaaagttcctttaggctgggtgcagtggcttatgcctgcaatcccagcactttggaacttcaaggcagaaggatcatttgaaacctggagcttgagaccagcctgggcaacatagcaagatcttctttctatttaaatctaaaaaaaaaaaagaagttccttcaaatttaaaaccatgttagtgatttaatattcttattaatcattgcaacctcagctctgatttgtgaatattctttcaaattctacgataaaagtgtttcaacgtatacattgttcttatctgtggtactctgagaacttcaaattcaatggaggagcacgagataagatgaattttattttaacttatcatccatctcctcttagttattatttaattattaatttggaataactcctttgtagtaccattttgatattgaatagtggaattaccatgctggatgtgctgttttgtgtagccatctctgtgtgttggggggctatgttggtcttgacattcccaagtgcagatgatgttgacatatggtaggtggcttgcaatttaaggttagtgattgggtagactcattaagtttacgtggtaggtcacagatggccattttcagatgctataggttgtttatgctgcattctcttggattttgaggaacttttgaaatgctgctgtcagtattttaaacggtattttaactttgcaaaagataccagtaaatgaattagtgtatgttgaaatacaggtagtaattttggaagttcttgagatgagagtagataggggaaggaacaattgcaataatatattttgttcttcttggatggacagagagctgaaaagaactggcacagcctgtggagttgcctggcaccagttggcaggcttgtggctggcctaaattggtacccttagatagagagactgcttttctggactagtagcccaaactgaatatactgccaagtcccaaagttttgaaactagaacatggtctgataatttctttcctggccttggtactttgcagattgccatagttcttggtagtagaatccacctggggctagtaagaagcgtaagaagcagtagagtgaggtggcacctctcctgggctacatctgcatggcagaagtgcttatttctttctcaggccacagaggcagaggtggtgcttgggataggttacatctctatgtctcccacctccaggcagagtgagccctctgagcagtgccatatgttttcctctctggcctttcagacagtccagtttcacagcaagcttatctttttcttgtaaatccttaagaaataaccaacccatactctggcatcttgaatttttttcaaattctctaatgccacaggcataaaggtccaagtctcaagataccacgggccatggtttagtccactatttcactattaaatagcgaagatgatcatcttgtcagtccaagacagcaggtcctcatgcctgtgccttagatcagccagtttttgctttttggtgtattatttagaacacttcacttcctggtaccagtctcttactaggtaaaatgctttttgttgcaaataatagaaaatacaactcaaacagcttagacaataaagagaactaattggcttacatcactgaaaacttgagagatgggagcaagcttcaagtgcagtttgatccagaggtttgggatgtcatccaggctccagtactaataattctaggtaattttctttttctctttttttcttttgagacagggtctcactctgttgcccaagctggagtgcagtggtgcaatctcagctcactgcaacctccacttcctgggttcaagcaattctcctgcctcaacctcctcctgagtagctgggattacaggggtgtgccactaccgcctggctaatttttgtatttttagtagagacagggtttcaccatgttggccaggctgatctcaaactcctgacctcaaatgatccacttgcctcggcctcccaaagtgttgggattacaggcgtgagccaccgcgcctggccaattctaggtaattttcttgccctgtcctcctccatgtgtcgtcttcctcttcctaccaaccctcctcatgaaagtagagatggctgcagtagttccaagtgtcacgtctgcaagtcacgccatccagagacagagaacctttgtcctggtatttgaagccacagtctcaagctcagtcacgtgtccagccttgaatcagttacactggctagaagatgagaatatgttgattgacttagcctagatcacatgttcatttttggtacccagaacagcatggattccttgtgagggctcttggaagggaggaggtagatctataacagtatgtgtccaacaaaaagtatccccagtgctctacatacattctcatttaattctccctagagccccatgcgaattcttctaatggtttatggaaatgtggagttagcaagtgattctgaaacttgtgcccatggtaagcacatagctccttcagagaaaaaaacaaatggatccttttggtggagcaaatacatgaactaatttcattgacatgtcaaagtgaaccaaaccaaggctagagatggtggtcacaataccagaaaccaccataagaagatatggaaatacccccacaccgtttccttagtgtcctatttttaccttgagaatgaggtaggctgtcactggatcttctcccagtgtccctaaatgctaaaaagataaacaaaacaaagcaaaactgtttgcatgattcaatgactcttggtgtcaccttttcactgtggcttgctttattgtattttggtttgcaaaatacaatattcagaggtcttcactgtttaccagttacctgtaactcagcatttcttttgcactctattcctctttggattagaaagttgggatgaggtgtaaaaaattagatataaattccacattggaaaagatggtgaagcgggtaattacagagaaagattggctgcttaattattgttacctgcagggaagctgtgttgtctttctgcagctgttcctataaatagactatatacaggaatccaccccagggcagagttcctctttgcttaatttaaattgctggtttgaggtagttatttttgaaacccttctcaggttgacttcccccttaatccctaagccttcttccctcatctgccaaattatatgtaatgcatggcagctagagtgcttttggcattacatggagcctgagaacttgaactttgattcaaatgttaatttattgtggacaaatttattgtgacaaatggtcctctccctgtgcaagtccttctgtggactctggctctggcttcaccgtctctgtggctcctgctgcatttccatagcatggcacgtgcctcccaccctcatcagttttgttctgaaacagagcccagccaacttcaaaatatacagagcagttctttgggccgacgttgttgagttttagtggtatctgggacttttctttctttcttttctttttttttgagacagagtctcactctgttgcccaggctggattacagtggcgcaatctcggctcactgcaagctctgcctcccaggttcaagcagttcgctgcctcagcctcctgagtagctgggattacaggcactgccaccatgcccggctaatttttgtatttttagtagagatggggtttcaccatcttggccaggctggtcttgaactcctgacctcatgatccacctgcctcagcctcccaaagtgctgggattacaggcatgagccaccgcacctggcctatctgggactttttgttccaggtgtatttggcttaaaattataaaaaacatacagtaacaaaaaagttactctattgtttttctttttagtgttaaatacttccttattttatttatgggagaacctctcataaattcatcttagtctctcttttttggcttttcatagccaaaaacttgttttaataggatcagtaaaaaaggatatgtttgtgggttcatataaattgctagtaattaataataatgaatttcttaattactagcccttcctagttctctttaaaccagaccaactaaatgtagtttctgctgcttctacaagacctactggatgttctagactagaagtgggggacatttgtttaagttgctgagatttcagtaaggacaccaacctttataagacatagtgtgccgaagtgactccttaataggaagaatcaaatgtcctttccactcattatcagtggcaggtatatatgtaagtatttattagtattctgaagtgtgattgagtatcagcacactgaagttatataaaactggcttctacattagaaacatttagagagaatggcccagatgaatttagttttaccattttaccatttagttctggtaatattaggaaaaataatacagacacatgtgtgcatacacacatatcccacacactcctatgctcagaaatttgaaagatttttagtactcttgacagtgatcagattggaagccttggggattaccattctgctgttgggtggcaccatgcacattagtagcagggtagaatgctgcctttgtagcgtgcctctgtttccacttggtagattttcacattgaaccaaagggaaactgtagtatttctggtctgtttactgcgtgttaatttgattctgctgttatagtggcatgtctgttggtacaagaattaaaaacgtagaggccacttttatcaggttatgttatactggtagcctgtgatttacaagtgggttgtgttcttttctttatatgtcagtattgattgtctggaatgaaatttcctcccatagatgccatgttagacgtggtaattgagttctttcacatcaaatgcaaaacatttttaagtaaccatagcaagtttcataatctctgagcttcaattttcttatcttaaagtgggaatgacaatacctacctcatagagttattgtgagggttcaattaatgtaaagttcttggtatagtgtctgatatgtggcaagtaaacaacaaatgttagcagcatcattttttatcatcttcgaggaagcaggttcatatagtctgacattggtacacaagggctgagggaaagtaggggtgggttaggttttttttcctccccctggagttttgcgactctctgctgaggagaagaccatggctttctagtggctttttctgtaggtggacttcaccagggaggatggactgggaaggaggttcatttgtggcagcaggttggcaaatggggcagctgcagccaagtcagaggctcctgatgtggttcatagggaggagaggttatgacattttttaaggctagtgagagtcatttggagctaccagtgttggatttctgcagtagtgccaagaacctatttgaaattattttgctcgtttaaattgacccctttccctctcttctgcagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacgtaagtacacacgaaggtcatctgtaatgtttagactttgtattttgtgccagagagctgtcttttcttcctcagactcttctttcttttttctctctgtttgagtccagcagtatttgctttataccctcagaaagagttgagtttttactgatttagcccatgagtaatgtgggttagacaagtcagtctgctttctgtgatcaactgtgtgcaagtattgtagtgggtgttgggggcattctaaagcaagcagaatactgccctctgaggaatttagaaggaattttgaaatccataggcatcttcttggataccttcataagattaacaaagtctaatcagggagaagctactcattgaaatgcaaggcagtaaactgtcaaaaaagacatgaactttctcgacatttgtagttagtagggacaggagcagattatcagataaaaatatgtaattggtccctgaagatttggctatagtcatgtcctactgtacaaaagtctaatgccatatacataaacagaagcataaatatgtatatgctataataggagaaaatttcctgttgtaaaaagtctttataaaggatttcacagggtcaagttctctaaatattttaaaaacatgaataaaaaatacatttatatgcagcttttctggagtttgcataaagcatctgcagaagtaaaggtgtactgttaactaaaccaaagaaatgaggcattgattccctgtacctgcagctgagaaggaaacagaatgttttggatgggagtagttttagtggactctgcctcacttcctgagttctctttcctcctttttaaaatgtgcatctgtgcatggagaagaactggattattgggcatgcttaatatttttctgtttatcattctagggaggaagtataaataaataaaagagataatacagtgatacaagtaggatcagttataacttttgtggaactaatatattttgtaaaattatatgcaaattatgagctatattattttatatcatagatagctctcttttctagatagccaactctctttatctgttggagctgcgataccaaaataccataaactaggtggcttataaacaacagaaatttgtttctcaacagttctagagtctgggaagtccacggtgaaggggctggcatattcagtgtctgatgaggacctgctttctggctcacagatggcgccttctaactgtgtcctcacatggtggaagaggaatactccttcataagggcactaatcccattcatgagagctctgtccttatgacctagtcacctctcaaagccccacctcctagaaccatcacattggtgactagctttcaatatataaactttagggagatagaaacattgagaccacagcaccaaacatgtttcaaggatgattttgagtaatgtatttatgagatagtagtcatcctctaggaattgaccttttcattcttctcactttgtattggtggaggtgggggaaggttgatggtaacaagaggcctgtgaatactgcttttggagtcttaattggataactggatactaaactgaaatgtgtttacagttcagagatgcgattatttaaagtgctgatccaaatggaaaaggtataaaacactgctgcagagcagggggtggcattgtttggcttggcagtactgcctggtgtcaccttccctccaagcgtagcagttctgctttcaggtgggaaagctgagggttctgcagctttaattgaaagtatgctctgatatcaaataaaagacagactttaaacattggtctttgagatggagataggcagaatcaattatattgtaactaacgttaccgatcatttttctttttggctctgagaagcacaattcacttttaaatgaattgaaaataagatggagagtagaacattacgtgcattcaaatacctgatttgttgtggccactaaaaataaaacaatcacctttttaacaaaatgccaagtgttaacattcatgagtctttagcagacgaaatgtctggatttcagctctatgtaattttattttctaaacgtcctttgtgtttataaaacaaaagcagaaaattgatttcagcttccagatattcatatcaattaatgtttttcatgataattcagggctactgtttccatgagatgtgtgcctttgttttgtaacttcaaacacctcatgttggagggctgggcattctctattataagtgaaacaagagattgtaaagtaatgcgtatagtatgatccttttgtaaaagatgtgtatgggggtttacgaatatgtacatatgtttgtatatatttgtatgtacagagagacaggtatgttaccttcaggtaccatagtggggtgggttgggatagggcatggggacagggaaggttactcttttagacctctgtattgtaggacttaagtcaatcatatattgcttttgtaattaaaaaaaagctgcatgataaatttgattaccacactctccagccccacatgccatgtattcttccctggtgaaatctatttctggctcttatcctgataatactcctgctttgcctttgttcatgggttgctgcaaagttgtctagcttgatgcccaaggctaagttaatatgacatggaacattttactgtcttctgcttcactctgtttttcaattctttccaagaaaatgaagatgcagttaaaaaaaaacatcttttaaggtcttatagcttcattttatattataaaaatgggtgactctctagggatgatccatcatgtgagcatattgaacagtaatttgtatgtttagagctatgtctgataagggggccagtgaacaggaagacccttgccccagacttttgaactctggatctggatacacccatagcctcagcaatctcctatgtgaaccagctctaaatcggggggttcagttctaacatcctgccatccatctcctcttctcctccctcccccaacatatttagaaatgaaaaatagtctgtatcttcccagagctctcgtgagggattgctttgcccctgggtatgagttacgactctctagaacattcacaacccctagtgatcctctggatctgtagcagctgacgctggaagcagactcccttgtcatcctgtcgtactaaacctgaagctctggatagagcaaggcattctggagttagttggaaatgtcaggtagtgttagaatgtgctttttgcaagtagccgtcacacccacatttattcacctgaaaatccagaagtcattctgctttcacaattggtttgatttagtggctcagtggtatcactaaggactttgtgacttactgtctgctttgccttccttggctgtttctttgttctgaggcttcatagtagcaaaccagctgcagcattccaggctttgcattcccgcatcgcgctggctagaagaagaggcagtgctgcttctcttctggcattccaagtcagagtcctgagatttaccttggttaggctgccggagtcacactcccttctcaaaccattgactgtggcccggagatggcatgacctgagcgacttaagaaagtgatgtttaagattggagttgaaccagatttttccaaagtagataggctgtatgtgagggggtgggttcccaaccaaatatatctattcacacactaagaagagaaaaggggcagtggatgccgaggagcccactcactgtgaactcctcaccggtttggtagggagttctgtaatgaagtggcttttttgatgttgatgtcatgttaaaggatgtgtccatgggaagaattggtcacttgagttctaggcttcaagtgcgcccaatggcttgcttctcagacttttctgctggtgaacttctaatggcagagaagagtaaacagcttcccccaggaactctggagcatggtcgaagtcctgcttcagggaaattttgccgaaatgtttactttcaaatgtaattcaaagctttatactgttctctagtgcagatgggttgttttgaactaatataccccttgtaaccctttgagtaagttgcatgctccagaaatatctgttcttcactttgaggtgggttgacacacttgtttaaatagcactggattggttcatagccatctgtggcctggttgagtctctaaatctgggacagtggcagatattgacgtggtcttcgcagttagggcttgggctattcagttggagatggaggaggatcaggtgagatgagatgggggaaatgctgaagtgatgctgcaacacacagggtcagagactctatttgctttttattcctccatcttggcggagtgtggttcaagctgggcccagctgcaggacatgctgtttggtctgacaggctccgtggggtcaatggctgggaaatgctggtcgtgacgttcccgagcactgcttttctgtttgctttctgtcctttgtcagaccttcttccggcctcccctccccggcccccaggccagatggatggtagcaggatttcatgtggacttttattgtgatgtaggagatggcagagctgagatccggccagacatgttctgtttttagggtgactggtcaggactgtggttctattcaggaacaggaaagctacaatttaggcaagaacaaggcccagtacaaatttggaaaccagagaaccaaggtgtctgttctctgacgagaagtatatttggtgctgaccagtaaatttagtttgttttctatctgaattgtaagattggggatcatctagatataggggcctgagttagtctaatttttagatcttatgttaaactaattgtagttgtaggagtgactactttaaaagtataggaaaagttgtcttaagttatagaagttaatactagaattaggattcccaggatgagattagatacttttatgaaagatactcaagatatagtaccatatatttgatttaaaatattgtaaagttaatgaaaacaatactgattaacacatttatttgaagtttcaaaaccacttttcatttatacacatgaaaatcccacctcatgggtataatctctgttcctgggaatttggcgtagatggagtagtagttttctcttgctacaaaataaagtgcacagacttagcaacttagaataacatacgtatattatcttgctattcctggggtcaggagttggggcctggcttagctgagtcctctattcaggattttcccagctgtagtcaaggtttcagcagggctgcaatcttatctgaggcttgaaccttttgcaggctcatggtggtggtggtggagagcagggctggagttcagacaaccacctgagtgttattcctgttactcagccctgttctccaagttttattctttataaaattttcctttaaaggttttttaaattacaaaataacaaatgcttttgggaaaaaaaaatttcaaatagtacagccagacatatcataaaaatgtagttttctcccttcagtaccacaggcccattcccagcgtgaacagtaattaatagaatgatgtgtaatcttcaagattatgttgggtgaaaaaactaattttcttgttctagagttggaagtaggaggaggttctcttttatctagacgggcagacctttacccaggtaatccagacccaacagagtttgcatggaacaagagcaatctttaatgccacctccaatcccacttagatgaagtagggaaggaaggaggagggatcccagccctgttaacatgaaatgcctagacttggttgtatgtgagtggtttaccatcagtagtgctcagcttactctgatcgctgcaaaggtagaccattaaggtaaacattgagaacaaattgtgtgtgccttccagagtgtagctttggtgtttgaaacggagacacagctttagaagcctagataaagctgttgaaaaacagcaaatcatgagggtgaagggaaatgtcatgtctaatttctgagcaccatctatctcttggacagtcatttttgctaataacttgccagcttcaacccatgcaaactttcctacagcctttggtgattggaaaatttcttcctcttagaattttcaaagttgacacatatttgttgcttaccaaacttagagagttttttcatcatggaggcactgtatagggcttgaaatatttgtataatacttacagtgcattaacttaaatattctggttgaagctaaacctaaggtttgatttgaagaaattaaggcctgacatcagatcttttggaagcagtatggtagcactaagaagcaaaaacttgacgtctagtcctggccctgccacttagtgagacctgggacaagttaactccttggagactgttttcttattggttggtaaaatgataaatgataacaaaggacatttttgatttccttattggtaccagctgctgttctaagcactttacatgtattattcatttaattttcactagagtcctatgtactataggtttttaaattatcttcattttacatatgaagaaaccgaggctcataaaggctaagtaactgtccacgatcacacagcaagtaggtgatggagctgaaactcacacccaggaagttcagctgcagagtccatgctcttaatgatagtcctgctgactttccatggttgctgtgagcatcaaaggatactactgatacaaaagccctttcaattctcaaaataattgggtatgatattgaagaatgtgtaggtttggaatgaggcaatctgaaaatgacctggacaaataatcaaaatgataatcagtattcctgccatgtgttgagctgctcagcagtgcagtgacatgaaccagcgtgacatagagcaaggacattcatttctaaagtcataggtgatcattacatggtgctctcaattcaaaggaaaagtgatagcagccatgacaatgattttttccccactgtggaaggtgggagaagatactgggaggaaagtatatttcatcatgttcacaggatgacaggtaactgacagctgcacatggctcttcacctttatgagcacgagagaggaggaagaggaagcagttcggcacaggggacacgtggccagttaattctgtggccagttcaactgtcccctctacacatgcatctgtgtctgttgtatatccatagtgcagaaaaattttaataatcctaatttctaaagagaggctattttgttgttcaaattctgctttggaaggagtggagggtgaaatgacatggcatactgggaaaggtgtgagcttttggctgacagacctgtttgaaccttggtgacttacagtcactgtgaccactgtaaggaatagaggttctctcacccataaaatggtcatcgtggtacttatcttgttgagttgtggtggggattaagggacatcttagtccagtgcctatcacatgatgaaagtggagtgcatggtaggtgccccgactgtctgaaaaacttggaaatccagaatcactttttttttgaggtttcagacattgatgttttctttttttcgagacagagtctagctctgtcccccaggctggagtacagtggcaccatcttggttcattacaacctctgcctcctgggttcaaacggttcttctgcctcagcctcctgagtagcttggattacaggcacatgctgccacacctggctaattttttgtacttttagtacaaacagcgtttcaccattttggccaggctggtcttgaactcctggcctcaagtgatccaccagcctcggcctccgaaagtgctgggattataggtgtaagccaccaagcctagccaagaccctggtattttcattagttagattctttctcttctccccttccctgcctacttctttccctctttctgtattcctttcatagcagttcctgtgtttcatagcagattcatttttgttacattactactttcaattaaccacagaaatattattttaaagacatattgtaaatattatccctttaatacaggaccacaggaccatgctgttaagagagttttattaagtctggagaatggtatatatttggaaaatacttgtctcgtgacacagtttgtctcaacgaagatatggcagtattgtattatcctgctctaaaataaagacgcctgaggtgatatttttagccagtatttcagcgtggcgttgaactcatatatagttctttaattcatagtctgaaatgactggctgcagcccaggaacaagagtataatatgatggtagtgtaggcacgtcttggactaggcagcagagactgtgcctgacaaacttgcggccaccgtcggcagccacggtttgcgggacgtcctggcctctgaatgagctcctgacccaaggccagtgatttaaggcacaacttagataaaaagatgagcaaggctagattctttcctcaaactttgaattgagaaatactgaaaaaataaaatatcaatgggatcaagatgctgagggtgatgaagtcgagaggagtacatgataggccacaggcaaacagaacctatgaataagaggctttgaagtggacagccgatggagtagaaagtgagggaaccagcttgcagcaggcatgaaagaaacaaggggagaagcagagacatgggcaggggcgaggctcattgataccagaactggagaggaaatcttcacaaacttgggttgtgttggttcatgagccgtcctggacccatagtcaccctcaggtcccagatttgttatagcctgggatagttgtcaggggttcctaggtgagttcattaatacaggaaatggacctggatgccaagcagctgaaagagcctgaccaagtcactgttctccgtcctattgtcatagtctttgatgcagagctttgggatgaaactctgcttctgccactgatttagaaaccttgggcaagttatttaaaaccttctaatgtttccagttctattcccctgtaaaattaggctattagcatcaattttatatgtctattgcatatgcatcacaaatatgtttctgagactggcgacatgagatgcatacactgaattacatttttaaaaaatataaggcccagatagacacctaagtctgttattcaccttatacttgtaatttttacttaggcattttgcacagttttgaactatgtctaaaaaacaaccaaagtgtttggtagaccatactgtgtctttaaaaaaaaaaaaaagaccgaggccctctgcaaggaaatttgggaaatcttacagatgtctaattaaaaacaccgtggcatatgacatcttaatatcttgtgatcaaattcccagggtctcagacccaggaaggaagtagattcctcatattggagtgaatagcatgttgtcatttttgaggattcccactggtctgtcttgtatagtcattttcttagtatcctagacttttaatattagttttattaagacataccttatgtgcttatctgaaaattcatcaatttcctgtatacaaagaccattttgggttgggtgccgtggctaatgcctataatcccagcactttgggagtctgaggcgggccgattgctttagtcgaggagttcgagaccagcctgggcaacatgatgaaaccccgtctctaccaaaaatacaaaacttagccaggattggtggcatgtacctgtagtcccaggtattcaggaggctgaggtgggaggatggcttgaacctgggatcggggctgcagtgagccaggatcgcaccactgcactccaacctgggtgacagagctagaccctgtctcaaaacacaaaacaaaacaaaacagaccattttgtaaaagtttttaagacgctggtgtggtaggactcattaatgaatttagccatggtattaacatattttatgtagactttcaagtcctgatttggctctttacagtagccaatagattccagtagagcccagctaaatttatataattataataggtaatatttatggaatgcttgctgtgggtcaggtgctgtgtttgatgttttgacacacaacctcatttaatcctcagaattagatgagggaggagctagtatgcttcttgtaaagatgaggaaactcaggccaggcgcggtggctcacgcctgcaatcccagcaagttgagaggccgaggtaggcggatcacccgaggtcaggaattcaagactagcctggccaacatggtgaatccacctctctactaaaaatacaaaaaaattagcttggcgtggtggcgggcacctgtaatcccagctactcgggaggctgaggcaggagaattgcttgaaccagggaggtggaggttgcagtgagccaagatcgcgccattgtactccagcctgggcaacaagagtgaaactccgtctcaaaaaaaaaaaaggtgaggaaactgggatgtggaaaagttaaataatgtgcccacgttcacacaaaactagagaattttgccagctaatttggagccaagacttacacaatatttcaaatacattgaagaattattattatgaaatgacataggtagaatctgagtaaagagcttaaatactatacttaggtcagaatgatgtgggttcaaatcccatcagtttcatcatctaagcccctcatcccccactgacttttcacttcaaaactgcttttggactcaagctcagactgcttacgtgaagttcaaaggctctctacagtttgatctcagtcttttttttttttttttcctggctttagcaagaattttttattccagtcgtaactactcaggggatgtctttgttttagggaagctgttccattctctgtctttggtatgtgcttgggtaggcctttgtgcctctgtctgtgttttaatctgtattctagcatgtgtcagaattcccttcctttttaaggctgaacagtgttccattgtacgtatctacattttatttatctattcatctgtcgctggacacttgggtgacttcctcctcttgggtatagtgaataatgctgctataaacatgggtgtgcagatatctgtttgagtccctggcaaattgtacttaaaaaaatatattttgaagaagatagcttagcttaaaaaaaaaaaaaagaagaaagaaaggtggtggctgggcggcattcagctatcacctgaaacctaacgtcttatgtcactctttggggggaactttgtccaaatcatgcccatctttttagaccgctcaagctgtctgtcttctctggagctttctcggacctctgcagttcatagtgacctttctttatataaccctggagcactcattagacagtaaaataatcagactaatggctcatttagccaggaatcacatcctgtttcatctgttttaatgtctagagaagttaactcttaaattttatgtttctctatctaaaagactcacttcctaagctatattataaacttcccaggcacacagacactgggagctttgtatttttcctaccatgcccagcatgatgttttgcataaagttagcccttaataaatttgttgcttgcatgtaaaatggtttgtagcctaaaatcactctatcagtcagtgcgattgtgcagccttgtgatgggttattcttacctgaatcctggcccatcctggatttgaactatagattggtgcaaaagcaattgtgatttttgcgttggaagtaatggcaaaaactgcaattacttttgcaccagcccaatactttagaggcaaaagtaacatgacttggagacccttggagatgcagacgactcctataccttctctgatatttctttgatgttattttagactaattcgtattaagatatttaaataaatattgccttttacatcaccacattcctgatttatttctctgaagttaaagaatgattacgattgaatcttttctggtgagagcaaacattttccctataactagaagatcttttccttttctgttttgtttattcctggcggtagaaggatttctcaggtggtaaaatgggaggcttttgcctaacagagtagcgctttattacacaaaggttgaagatgctttatatggcattgtgcaacacaagtttcctccgttcttcttgcgtgctttttaccaaagcttcccaggcctaacagacggcatggattgtatgctctaatgaaaagagaacagattcttgtctccttgtcttgatttcacttctgctagctaatgtggtcgtatcacttaacttctttgtgctcctttgttatggacattaagatagagaatttgtatctatctcttggggatttgggagtagtttagtagaaaggtgtgtatgtgtatattctatgccagctgttcaataggttgaggatgagtttttaaggaactccagagacatgtaaacaaataactgaaattcatcctgaagaaaataaggaagcaggtaggtagacagattggatgcctagttagagcccagcaaacagaggctttaaaaatagattttgagagaattcgatatttcaaaaaaagcatcaaagtacatgatggcaaaaataggtcattatgggattttcttacatgtattttatggtgtagttatacattttaatatcatatgagaaactgaaatgtaaaccttcaggatttagggcttctaaagatctctatcttaccctgggaagaattatgatataaaagatattaaaactattctgactttttagaagaagttttatatacagacttggaaatattctgactgttctgtgtatgtgtgctaatgtttcatttatctgcctttgcgaaggaatgttacacattattgagacttacataatattaaagctgtgctaaaatatttaactttttggttagatatcattctaaaatgtattgcatatatccttgtcatcaaaaacagaatacactgattttggctgttgattattaccctacgttcccaattagtgccataataaagcagtcagggccggctaagccatggggctcttgggtcttactataaatatttttatactttgataattatcttcatcacttcttacttattttctttctttctttgtccctccctactcttccttttctattagtggccattgtttctctgcttgcagagggagtcttaacctggtatatcacatgtatgcagacttcaatgtgcatgtgtgtttttccaaggagaagagtcattgcttccgctggtgtctcaaagggatcaacaattgaagaaaggttaaggagtgctgtgtagcacaattttttaaactgcaagtttcatatcattaattgctcatgaaaatcatttagtgggttagggccaacagtttttaaacattttgtaaaaaatattagaatcgaacaaaaaatatcaatgtatcacatatagtaaagggtacttttggttttgtgaagtttttatcttgtatatgtgtgtgcacataaatagacatacatacacatacctggttgtgatgaaaattttatttcttatatatgagttgtaatcaaacatttcaaattcacagctatagtacggccctttttgcctcttccaatatacagatgttgctgcagtttttctgtagtctattgagactatgccaagtttattagaaatgtggctaaaatgagagtgaggctagaaggacttttcttttgtttcagaactagttccataggagtatttaaaggggaaggtgaaatagaagataagccaacagcagcactagcaggttgttgcaattgagagtaaaacctggtcctgtgagtctggaagggaagggctacagacattggttttcaaccctggttccacattagtttatgttgggtctctttcaaaaaagtactgacccctggccgttccctacatcattgaagtagaatctctgaggattggagttctgaaagaactttcttatagaataaaacacgtggcctttaggttatattttgactactcaaaggcttttcgtttggcttctgaacagtggtctggggagtggaggtggctagattgaatgtcctccagaaaagacctctgttttcatggtaattatgctaagaacactcaagtattatttgattatttacaagacatctgttttggaatgctagagatacttgaaatctaggaaggtcgagatggttttgacttaagaatgtttgtgcattcttgattcagtgtctgcccttgagaaatgaaatataaccttgctatctgtatgtgccaattatagaaaggtagagcttgttttcttctccctcttccctttttcttctctttcattcttgtttgcttctcttccctcccacatctctttcctttcttttcccttcctgggtgtcagaggctggcccactgagcagaggcatagagggagctttccattgtcatattagtggtggcatggacctgagggcttaggggagctgaggttcagaaacgtggaggggtgagcctagaaatgcctgggctggttacttcataatgagttggtttaccatcctttttagagcgtgatgcaataagaaaataccaactgtaaatagtatgcagttgtttatttaaaaaatgacatctgattcacaagtccaaatgttaatcaatgtaaaaatgaactgtctggtcactatcattctgatccttgaaaaggagatttaatctggtgctgtagtcacctgaatgtagaattggtagctacctaaaactagagtagaaatgttaaaccccacccagcaatcagctgctatcaggaatgtctttctgtgtctcagaggaagcagagttgtgactgtgaacatttgagttattctactggcccatgtaggaatatttaaacctttggctaatgcacatagaactttgaggaagaaatccataaacagaaagggcaggtataggatgaacctgttaggagttcaaggttagaagataaagaggatatctgaactgtataaagtggaatggagagagaaagcatagtttcttttagtgtttgcttatttaggtggataaaacttgtcctgcttggcaccatttttagtttcttgagtcatgtaggtattgatgaaaagagtcaaactctaaaatatttaaagagatttattctatgccaaatatgagtgagcatagcccataacacagccctccttgggagatcctgagaacatgtgcccaagatgattgggacattttaggcagacatgagacttcaacctagagaggtagaacagctcgaagcagtgaggcttccaggttataggtagatttaaaatttttctaactggcaattggttaaaagagttaccaatagaaaggaatgtgtggattgctataagaggttgtgaagaccaaagttttatcacacagataaaacctccagatacccggcttcagagacaatagattgtaaatgtttcttatcagacttaaggtctgagtcgatgttaatgctggagaggtataatgaggcatgttcgacccccacttcccatcatggcctgaaccaatctttcaggttaaattttagagtaccttggcctaggaggaagtccattctgatggttgaggggccttaggattttatttttggtttacataggtgtatcagttactgttgccatgtaacaaactacctctcagaaattaaaggcttacaccaacagccaattatttgctcacgattctctgggatagcaagttagcctgagtttagcattgtatattttctgctagtctcacctggaatcactcatgtggccttaggcatctggtgtccttactggggctggatggtttaagatggcctcactcatgtctaatagttagtgtagcaggctgtaggtcaggataccttagctctccacaggacctctctgacaggctagctcaagctcattcacatcatggcttccagccacagtcataaaaaaggagacacatcctaatacacaaatgcttctcaggcttctacttgtgtctcatttgctaacttccctttggttaaatcaagtcacagggagaaattccaattgaaggagtggagaaaaaaactctatctttaaagtaacaaagtcacatttcaaatgggaagtgcatgcagggatggaaagaattgttctggctgtttttacagtctaccagagtcaaacgacatttagggatttgttaaatggtaatgttaccggaaaggagtcccaatccagaccacaagagagggttcttggatctcacgcaagaaagaatttggggtgagtttatatggtaaagtgaaagtaagtttatttaaaaagtaaaggaataaagaatggctactccatatgcagatccatttttatggttatttcttgattatatgctcaataaggagtggattattcatgcctccccttttcagatcatatagggtaccttcctgatgttgccatggcatttgtaaactgtcatggcactggtgggagtgtagcactgaggattaccagaagtgttctcatcaccatcttggttttggtggatttgagttggtttctttactgcaacctgttttatcagcatcgtctttatgacctgtatctcatgctgacctcctacctcatcctgtgatgtagaatgcataatcatctgggaatgcagctcagtaggtctcagccttattttacccagcctctattcaagatggggttgctctggttcaaacacctctaacagtaacacatggcatataggctgattaaaatactaagcactgagtatagtatatttgatcttatatttcaatgcaagaataattagatgtgtttcagtggcttgtaccctccaattagtgatgaacataccccatgtgatttggtcatttagttaacaaatatttattgtacatcatggtgggccagacactgttctaggtgatagagatgcagctgggggaaaacaaacacacataattcagtatgtgtaacagtcacaaggaacaaagagaaacttacaacttattactgtggcttttgattttgaatttgaggcaacagagtttgttccctgtgcaagaatgccacagaggcagatttttatcaagaatttagccactgtgaagtttggttttaaagagcaactcagtaagtggtttttctgctaacagcaaatcaatatattttagaaactattgtattcaagaaaaagggagaaggattcaaatagtacttttctacttaaagaaggttgatttttttaaccaatagatgttaaagaaataaccaatggctatattttcatatttaccaaggctactaattctaatgtattagctggaagctattcagacaagtattcagtgtcaggcgtctcccatctgatgtttgcttgtgacattgtccttgggagacatctcccatctcctaggtgggttgcagtgtgaggacaaccagaaaaccttgagaaagttttgtcattgtttgtgaggccagattaattgggtcctagtgatagaatgttagaaataaatgtgaaaaattgcatgggaactgagagttttcttttacaacagcaatcttgtccacccttgacaagataatatttgtccacctttgacaagatagtattcttacaggatgaaagtgtgtttatatatatatataacctgttcagttttcctagttgggagaaagtccttcataattaatatcattgtgacccctgtaaaaagaaaaaaaaaagtcagcagaacatttctacgttccttcattttctattctgtttaattttctagaaatatctgacagtctttttgaatcccagtggtggtaatactggaaaaacttgttgctctaaaaatggtaccttttgtgggatgacattggaaaggtgggaagttggagatctttttttccccttgtttctttctttcctttatgaacctttttctttttaaaagttatatcgctcatcactttatcacttagtttatcactttaccacttttgttggcaccttttttccccctcctgtcttttatgatgttgaaactgaaggggaaaatggagctgccaagataagttacagttaagtgacgtttgcttgtggcattgtccttggcattgcacagaaggaactaaaccagcaccactggtgctgccaggaatttagggtcgaagtagacaggaagagaaattgtgttctggtttaaagttcagtgagaaaagtttagtacatgctaaaatatagcactgatccctcagaaagtgcatttaaattttacattaaatgtaaatttgacattaaatttaaatgttgacattaaatgtactttctggaaagtacctttaaatttgacactaaaactctgatattatgttagatataatgagattatgtggtttgaatgtccaagagatacctgtagctctgatactgaattgaacgtgatctgagcccattgtggaaagattgacagacttgcagagggccagtgccaaagggaaggccctatgaggtgtgggtagggaagaggggaacactgggatactgttgactaaaaaggtggaaaaagatgagagaagaaggggaactatagctctatctagaatcagggagagcatggctcttgcttacagttagcagtagtttgtgacaaaatttgtggaaaatatgacagggctttggagaactcttaccgagaaccgtaaattagttcagagatatactttgaaaggattttaaatatataaatgtatgctttccatttatcaacaaactaaatagacattgttgaccatctgtcttcagagatgcaaagcattcttaaaatgtatacaatgaatggtgaagcagaactagtgttgattttaaaaggttgaaaccatacaacactaaagcttaagacgttaaaatacattttgtgtactaactaatgggcatgttttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggacatttcagaaacatttcagaaaactcagtaactggattcattgagaactgcctcagattcccaaacagcattgataaggaaaggctgagaagggagagatgagggaaataatcaaactataggttgagcatccctaatctgaaaatccaaaatcttaaatgatccaaatcagaaactttttgatcacaacatgacaccacaagtggaaaacaccactcctgacctccaaatgcagtcaaaatgcagtcatgcaacatagaattgattccgtgtccctaagagaaaggtaaaatttccttcaggctatgtatataaggtgtatattaaatataaatgaatttaatgtttagacttgggtcctatacccaagataattttgtatctgcaaatattcccaaatctgaaaaaatttgaaatctaaaacacttctactcccaaacatcttggttaagcgatactcagtcgatacttaatctccttccacttagttgcaatagcactgtgacagtgcaccttcagatattttagttaccaaatccactggccttttgtgttgggtgattgccttttaaccttgcagcagttgatgcagtttatcaccaacagatggatcttctaaaatcagatcatgttactcaccttcctagaaaccttcatgggctccctattactcccagttcctttagtgtagtgttcaaggccctttacagtccagctttagctgtcctccctgctctcctccaaaccccactactctcctttgtggaatctcctcttgagccagagccattcatgtcttttcctttctacgtctcataccctgtaccttatctccactgttaaaatcctgccagtcttctatggtctgtctgaaagacttggtcagccccagcataatccacaagggacttgcactggccctgagttatcagaccactcgtggtcgtcaacacacctcttcttgctatggttgattaggttttggtgtcaccctcttgaatgagatagaagcttctgtaggttagaaactttatcctgcacatctctgtggctgtctccagtgcttttctcttcagagctcaacaactataaaacaaaagagattttaggtgatttttcattacattttacctgtgttatggctgagagttcaatgaaatcaaaatgtacttgataggatacttgtggagtttattcaaaatttcatgcagtataatgagaatttttttcattttttaaaaaaagcaaaaatatttttatggtgctcttcaactcttaagtatttgttcagcttcgatttgttcatgttgtctgtatgtctattggaaggaacttgccaccagaagaagagtgtattgtggtacctggcaacaagccctctggtggtcatagcccaggagtgagctgagatgtgtccttcttaagttaggatataatgtgatggccatattaccttaggcattgcagtcacaaggtgaagcagtctttccatgttagtaaattacaaactcagcaacaaatgttaaaacttagacaagtggcttacagctttgaataatttctggttaccctcatttaaaaatgggtaagcaattagtgggagcacctggtatagtgctaatgtcagttgtccagaagtgagccctccgtctgtggactctttgacccctacttttgggccagactggtttttcaggatcacataccgttgcccatgagtgatgttgctataatgcttgtgtgttttgagtctttgttgatcctgttaccattttactccattcaaggtgaaccaaagtaattttataaagaacatttctgactatatctcaaaatgtaccagtgctgtggttgagtatacagaggttaggttaagattccagggcagaagactcacacattatttcttttatgtagtcagttttttttttctgcaacggagttgaaattctgtgaattaaagctgtgtttgagagctcttattgcaagtagattctgaattctcctgtagaggttgcttgtgcaactggatgtgaaagtgctttctgaagggtgtgtgtgcgtgtgtgtgttgatgtgatgttgctgaggctgttgtgttatttctttcattttacttttggaatagttgagcccttaaattgatccagtacgtctccacaaataagttgcagaaaagggttttatgctttcccatctagcattctttttatttattactgtagaagagatattcatttactgagcaaatatttattgagagcttaccctgtgccaggcagtctttcaggcactgggatacagcagtgaacaaaacagataaaattcctgtcttcatgagagaggctaaactccagcttaagtatttagaagtcaagattgtacacaccattggttagaagggaaaaagggaagagcagaggaagggaagctttcatgaaaaaaaaaaattgaatcttaaaggatattcttataaaaccccctttgagccatatctaaggcagtttaagtcagtagatgacagattgtggtctgcaaggctttgcatctgtccaggcctcagatctacgcaagtagcttgtacagaaggggattagagctttgtttgctctccagtttagatgccttaaataaacatctcgtgtgtaatgacaccatcttgaaaatagctaaaattacccttttccttttatgcatgactgtcatgggtcaaaataagcagaaggcaggcactgtgtttgttgtcagtcttgggggatatttgtttgattctggacaacaaggattagaaaacttcttgacttaggcgagtttcatatcagcagtgcaatgtccatgtggtggtcaagctctgctgttgacttgaagcttcctgaggctgggtctgcagtgggaaacatctctgggcgtcgcacctaattagcttctgtaaatgctccacgaactgaacttgctgcctttgactttcaaagttttcttcccagtatgttgctttttgtggctattttcaaaacagcttctttcagccgggcacgttggctcacgcctgtaatcgcagcactttgggaagccaaggtgagtggatcacctgaggttgggagttcgagactagcctgaccaacatggagaaaccctgtctctaataaatatacaaaattagcctggcgtagtggtgcatgcctgtagtcccagctactcggggggctgaggcaggagaattgcttgaacccaggaggcggaggttgcagtaatcagagatcatgccattgcactccagcctgggcaacaagagcaaaaccccatctcaaaaaacaacaacagcaacaacaacaacccagtttctttcaggatatgtactcttagcagaaagagacctcagctaatttttcttccagatcatgaagcttttaaaactcaagtaggaaggttgatttgatgccagcctaatgtttttatcatgaaaattgttatgatataagaatacatttattaattgaaaagtgtttctggtacatctgggcagtttcagaatcctaatttctagaccctcaattagagtttatatcccttctcaccaaatgcacatctcagactcgaaagagtttattgtaaaaatgctgtttgtgaagccaagcctatgttcacaccggcatacacgataatttcagtgatacaatcttaaagggaaaagtttggttctcagcaaaacagctgctaactgccaagatgtggctgacctttgacagactctgagaagttctgcaacatcctggaaaagatccatttcatctggagaagcagcactgaggccttggctgctgaaggattagtataattacttcatccctgacagagagagccacagttggaacccacctgggaagccttgtctagggaggtgggaggggtgctggccccaccctttgttgttgaaattggaatctttgccacaatctgttgctgggactggtgtggcagggtaagtagggccaaaggagccctgtggggatttgtctgaacaggggctgacaaaagctggtccccatccagccagcccagggaagttagcaaagccagggataatgaaagtgttcagcagagcgaatatgaggccctagtcgtgagactgcggaactgagggtggtgatggggccaccacaggggtagaaactcacgtagaggggaacaggcccaggcgtaccagccccaggttccagttccagcctgtcccagggatcccagatccccaagtgcaagtgattgttcattcatctgataaacatgattaagcatccacaacatgttgaggtgctgggaatacaaagatgaattttcccttaaggattcacaggctggcgtgggagacagactgataaataaataccgaagggagaaagcagccataaaaaaggtggggcatgtcctggtttgccctgggtagccctggtgattccttttgtagcagcataattattaatagtgctcttggaattaacagaagagtctgagaatgagcagtaagtggtgtggtcccctgggaaatggggtacagccctgcctgaggagctaggagatgggatggaggacccttaggtgatgagtttgccgcatggataaagaataggactctaggctcaggagagaattttctagtcagagggaacagtgttgactcagtcattcatcatacgttatttgggtgcccaccgtgagccatgtactagtgtacctactggggacacaatggacaaaaatcttggcctttttgtgcttacattctagcacagagagagacaaaacacaagagacgttaataaaacaaatggcattttaaatggtgacaagtgctgtggagaaacaacgtggggaaggggcatcagggctgtgggggagtcacgagtggtttactggtttaaatagggtaaccagggagtgctttattgagatgttatatttcagtatcatcgtctaggggtaagagggagagacgtgatgtgttgagagaagaatgttctaggcagaggcaacagcagatgcaaaggtctgaaggggagacagaccgagctagaacagcatggcacatcagtgatctaagttcgtgtggtttcctaaggttggaacctagggtgcaaactgaggatgggcagatgaggtagaagaggaagagcagacccaggtcacaaagaacttttgtgctaaggatttttaagcaggtaggaggagagagaatatgagccttgggatttgaactgctgtgggtgtacagaaaaagagaaactcaacgagaggtttaggtttagggacgtggtaggcttttgcagtaagggacaaggacagaaggctcatctgaggatgggagggacactttagaggcaaatccataggatgcagtggctgaacagaaaaggtgaagagagagggagaaagggggatcagagggagaaagggggatcagagcccagtcacaattcctggctgggatggagaggttcagagtcccaggcaacccctggaattgcaatagcctggagatagtcttgggaagcagtagtgggtacctagaaaagcatggctccaggtaattgacagcagataattgtatgtttctaacatcatttctgataccaggtgtgtgacatttttcccccagcaccaaccagttatctgacactaactgggtgtccaacagttcagtttgtttactggaaaggggtcccccaagagagagttcttggatcttgtgcaagaaataattcgaggtgaatccacagagtaaagtgaaagcaagtttattaagaaagtaaaggaataaagaatggtcatttcatcccatgaacagagcagccctgagggctgctggttgcccatttttatggttatttcttgattatatgctaaacaaggtgtggatttttcatgtgttttccgggaaagggatgggcaattcctggaactgagggttccttctgtttttttttttagaccacgtagagtaacttcccaacattgccatggcatttgtaaactgtcctggcgctgctggtagtgtcttctagcatgctaaagcattataattagtgtataatgagcagtgagggtgaccagagggcagcttcctcgccatcttggttttggtgtgttttagccagcttctttaccgcaacctgttttatcagcaaggtctttataacctgtatcttgggctgaccttctctctcaccctgtgactaagaatgcctaaccttctaggaatgcagcccagtagatctcagccttattttatcgcgcccctattcaagatggagttgctctggttcgaacacctccgacaaactcagttctgacactaactacacagttagcacagaccacacaggtcaaaggcttagtcctacaagagtgccccacttcagacaccagccatgaatggggtaccctgactactcacacttctgcttagtcaaccccacacgtttgggggtttccatgatcctcaggttcaataatttgctagaacaactcacagaactcaggatgatacgttttttaacatttactggtttattataaaggatacaacacaggaacagtccagtggaagagctgcagagggcacggtgggggtgtgtatgcagagcctctgtgcactctgggaataccaccttcccagcatgtcagtctgttcaccaacctagatccctccatctccccaaaaaaacagaattgtgttcaaatttttgtaacccaatctccagctcccctcccctccctggaggtggggaggtggggttgaaagattcccccccactctaatcacaggcttggtctttctggtaaacatccctatcctgatgctactgaggggccccacctgagtcccctcatttgcataacctcaggtatgggcgaaagggacttgttatgaataatacaagatactcctgttacccaggaaattccaaaggctttaggagccctgtgtcaggaacctgagacaaagaccagatacatttgtttttataccacagatgtggacatgtgtattatacattgttcttaagaagccatagaaagcttgtcctgaaatactcgaatcctggcttcctgaagccaggttattgttggagtttctgtatacaattttagaaagctgaattagtaggccacctttttccaagacatgtttaagggtagcaacagttcaactcaataaacatttgagtgttgtgtgcccaggatcccattcaacccctccaagtcatttcccctgtctactgccttatcttttttctttcttcttccattcccaccaacataacatgctgcaatgtttctcttgatttcacatctcctagctaccatgccatttgtttcctttattaccaaactgtttgaaaagttgggtatgcttattgtctctagttcatctctttttcttttgtaaatcactctaattgggctttcatctcccactccactaaaacttcttttcaagatcatttgtgacctccatgttatcaaatcccatggtcagttttgaatcctcttcttcctttatcagcaacatttgacaacatgaccagctccttcctggaacccttttaaaatttggctttctggcctccacattttcctgtctttcccccgccttgctggctgctccatatccagcctccgcattcccgtggcaagtccaggggctccactctgggacctttgcttttttcctctgtaggcattatttagatgagcctacgtgggcttcaaataccctctgtgtgctgatgatgcctcccggatttagatcttcagctggatttctcgcctgacctgcaggcgatccagctatgttgagctctgcagcatctctttggataaggggcatctcacaccttagcacgcttcaaaccagacttaggattgccccactccctcttctctttctcaccttggtcagtggcagcatcatcctttggttactcgatgcaaaactgtttttttccttttctcctattgcacactcagtccatcatcagcctgatcatcctaaccacgtccatagccacttgtgcgtgtgccaggccactaccctcctttgcttggattatgttggtggcctcctcactgtgtccctgcttcaactctcctgttgcctccgcctgcctcccctcaaccgccaactttcttatcttcatgaatgttatggccactgcctagagtgatcttttttaaagatctccatcagattgtttttctttgctgctcacaaaacctgcagcaactcccttgtggcctgcatggctccacttgatctgggctctggccacctccctgactgcatttgttacttctcaccctctcttccccagccacgctgtcctccttgctgcttcttgaacatgccactgtcagcatcactcttgtaccatagaggggctgacttgttctcttactgcaatcaggaatagcaatccctgaaatagccaagtccttccccaatcacctgttattctcttaggctactttatttttcttcagagcatttgtgcttacctgacatcttgccatgggctcattttttgttactttattgtcttttgcattagaatgtcatctccatgagcacttgcgctttattttaccatccctgtatccatagtaattagaacaatgcctggcgcagagcagccactccataaatattggtggagtgagtgaatgaatgaatagattggtggggagtgggagagctgctgttggttagaaactgtagaagacatggttttgtctttaaggattgtccattctagttgtgggttgggggtagctacataagctgcattttaatgtaacagtatacttacaaggaacaagttggaagtgcagaaaaattggtgggttcagaaattctgaagatgccacttgtgttgagtcttgaagaagaatttttttttttaagacagaatcttacactctcaccaagtctggagtgcagtggcgcaatcttggcttgctgcagcctccacctcctgggttcaagtgattcttgtgcctcagccacctgagtagctgggattacgggcatgtgccaccacgcctggctaatttttgtatttttagtagagatggggtttcaccatgttgaccaggctggtctcgaactcctgacatcaaatgatctgcctgcctcggcctcccgaagtgctgggattacaggcatgagccaccacgcccgacctgaagaaggaattcttgaagtaggtggcttttgtagtttatagaagataagacaaaagaccagttttggctatggcataatgaccctgaatgttaggaaagggaaacggtattagagttgagaatgtagagctatttttcaattttaataaaacattccaataccaatctgcttgaatcattgggaagactgaaggattatgaaggttattccaaagtaataggaggagagtttgggataaggaaattacttaaaattgcaagctatgtgtctggaaaaattgccatcttgcatttcagtcatgaactggaaaaaattttcagacttgttaaatatgcctaagtgtatatgtgtgtaaatgcaattttttaatgaatgagtggtgaatgatttaatgttgaaatgatataagtgtaaacagatgttaattcatttgttttacaacagaatttctagttgctattggtgatgagtcacaatgtaatttaggaaggggcaacatttgatatgaagaatactgattttaacctttattaactcttacgaaaccctttgaagccacccccttagtatattagtgttcattggatgcataggtgatcagcttgagatccaaaaagaatatccttgtatcctcagttacagtaggaacttcctaagccttatagatgacttagcctgctttcacataaatttaacaagagaggaataagttagagtatatacattttctactaatctttttccatcagtccacatcaacagccaaaacttaggctgttttagcacctggagggagagatgatttggatggttttgcaccacagacctctaccttgggaaaacacatgcaggcataatcataggttacctgcggaaggtcttaggttactggcttaagaccggagggtttcatttttacttttatcctctatattttcatgaaggatgggtcactaagggcccttggatgtttctttaggaattgctagtttttaagccgttgctttgccttcgaaagacatattttcacactcatacaccctacctcacgtttggccatgcagtgttgctgctgcttctatctatatttataattggtttggccgttattaatagcagaagcttatgcatatttttctcatgtgaatagcattatggattaaaaaagggacattcaaaatggcagactctcatctaaggtcagggaaatgtattaaagaaaagtgttactgaagtataaagatgttaaaggcataaattataaaatgaacacatgtagctatttaagattacatgatagagtgagtcatggctatctggttactcattacctggaatgtgggtatagggaaggaggaagtgtggaaacatgtgcatgggtgttggtcattgttcctaaaacaagtagaaaatgatatataacactttgaacatttgcctcctttccgtaacttaacataacttttattataagaatattatatctatgattgattgttaatgtcatactttgtcttacaggcatagcttaggtagcatagatgcattttaaattttgaaaatctttgtccttttctatatttagagactttaactttctttgatgtttacaaatatattgcattgatctttaataggactcttaaaattaaagccagcgctaattaaaaattctggctgtgaaaatagagaaattgagttcgataaatttgtagctagtgatcagttatacattttttttcacttggcctcttgtggcctactgtttctgaaatcccactgtttgcttcatttctcctctttcacagacactctggtctatattctgttttactcactccacatattcaaatcctgctcatcttttgcggtatatgggaaaccacctccattctgaagcctcttctctaaaggccacttggtggtccaaacacatatggtccatattgtgcattctgtcacaaccatgaccttttatttatatatgatttttattaatcatatgacttttatttatcttatgtatctcattgattgtttcctatttaagtattagacttctacaatagtaagcatctttggaagagggactatacatggatactttgttgcttcaagatcagtggtcttaaaatctgcctgtgtttggttatttatagttaacttgtcaggtaacaccatccaatgtattgtgtgtgttataaaacatacacaagactgggaatttttaaaaagtgatgaatacagaaatataaatagaagttctgatgtttatatttgtactccagtggctcatcttgggcatgccctgggatgcccacacctcactttggagacctggcattaggttcatagtaagtattcaggaaatatttatttttagccttcagctattctgtgctgcttactgacaaaattcccacctattggaaatgaaacttgagtttatagtctgagtgtgtttgagaccttgtaagggggtataaggaacgattagtcagaataaggtaggttatttttgagtggcaggccttcctagctcaaggcataacacaacaaaggtttgtttctcatgaaacacaatttgatgggggtctgttgggttttctcagaggctctcctaaaaatggttactcagatatccaagctgcttctatattgtagttataatatctggcacacatggctttttttttttttttttttttttttttttttttttgagacggagtttcactcttgttgcccaggctggagtgcagtggtgcgacctcagctcactgcaacgtctgcctcccgggttccaggaattctcctgccttagcctcctgagtagctgagattacaggtgtccgccaccacgcctggctaattttttgtcttcgtttttgttttttgagatggagtctagctctgtcgcccaggctggagtgcagtggcacgatctcggctcactgcaagctccgcctcccgggttcacaccattctcctgcctcagcctcctgagtagctgggactacaggcgcccgccaccacacccagctaattttttgtatttttagtagagacgggctttcaccgtgttagccaggatggtctcgatctcctgacctcgtgatccacccgcctcggccccccaaagtgctgggattacaggcgtgagccactgcgcccagcaattttttgtatttttagtagtgacggggtttcaccattttggtcaggctggtcttgaactcctgacctcaggtgatacaccagcctcagcctcccaaagtgctgagattacagatgtgatccactgtgccaggcccacatggcttttaagattgctgtggaaggtgaagagagagcatgataagatcttcattggccagtgcatagtcacatgggcccagcctaactgcgaaggaagctgggaaatacagtctcctcttgtgcccgggaagggagaatggaatgggatttagttaatttatcacatggtctcttgtctgctaggattatttcagtaaggttgttggctgtttggtaatttaacttgtggataccatgtaaagcaagcttctgtgtgaatttaaacatgagttcagtagtataatttagaatgaaagacctcttaacatattttcaattttttaaaaaataataattgtaatcatggtgaatttccacatttccagtttaattttatttgaatgcatttctacagaagtaaaactgttcatccatttttcatgtttctgttgttactttttttctttcacactattgttcaacagacttcagtagctttttggtttattatcaataaagacttttctaatagtgttatagttggttgctattgcttacagaaatagttgatatgtgattattggtgattatttgaagatgttttagtgcattggtaatttattggagtagatccatctttgttccaattctcatattactgattttcttggaaccaatatgtctgttggaattattagaaaattagatgttggtctcttctatattcattcacatattcatccattgggaatttcagtaaaatggttctaaccagctttgaaacttaagccaatgcaatgttaatgtttttggattcaactcttcccagatgggtgatgaatacataaaagtcagtttcccctatattcaagaacttaaagttgtgtttaaggacaactttaattaagttcgttttccacatatgactatagtcaaagatagaaggtgaagaaatatgaaaattttagaaaagattacagaagaatatttttgttaagaaaggagaagaatattgggttttcgcaggtgagatggggaagtttcaggttattgcgtaatgcattaagagttcctatttccataatatgagtcagggcaataggctttcaaagcttctcttgactcagtggtgctatatttttaaattgtagattttttattctgctgaacctgtgtgtgtctgtttgcatactgaagatttttctagatttggtaagagttgcaaatgttacaggtgtaagtgaatgaacaaaaattatctgggcaaatttttagctcttcttataagggtggtttgtatattgtgaggcagattcatccacacccccaccccttatcctcccaccgtccgtccgtccatccatccatccatccatccatccatccatccacccatccatcttcccatccatcttcccctcctccctaaaagcaaagctcttcttgtgtgcatatattttagtcataccaattgccttttttagtttttatggttcagatacatgtgaagatcaatgtgaattaattgttatattccccactttcaaaattatcttccctactattcaaaatagtaagctgcacagtaagctgaccaaaggcagcttagtattttatagtcaatgtaataaaataaatagctttctaaaactcagagcaaaggaaacatagaaaatagatgagaccccagtgaaagttaataccatgacatcttctaagcttactgaacttgaacttttcatttcctggtagtcaaagcaaaaaagggaaatgtgatcagttacattatttttgcatataagaccaaagtgcattgctcaaaagaagcaaagttttctttgccaattagatttcaaagagatttctcctgtgagactgactatgtgaagggtgtcatcatgacaacacctcccaaaacttagtaatgcattttagatagctaattctcatgttactaagtggaagcagcggacataacaccaaagcacagtttaggaaaagcgaatctataaggatttagatttaggaaaagcaaatctataagaggtataagtaagtggctgtcacccttggctgtctgttagaaccagtgcagaattcccttagaatctatagggttggggaaggggaacaaggtttcggctccgtaggtgcctagtatacatctagggatgagaaccataggtacaagtgctgagcttattgatggtttgactcaattaaagagtacaaggaacagatagattgcatatttccttcaggtgccttgtagttctgtgaaagttttttgtgttcatttatttgttttctgttttctcataaatgggctttgaattaaaggtggtcttcagataattggaggttttattctctggtaagggcttagagtacacaatttccactgccaataaaagatccttaattttaaaattcattaatagattggtctgccttcattttatgaaaatttaggaagcaaacctagacttgtttgaatagatggcccctcatctctacagagatttctacagagattaggggccataagtcatatgataaatagaaagttctccagactggaactgatttatgataatgattcccagtctttgggcctcgggagttattgtagggattgctgttttctcaatcagtaggtatttgaagtacacatatttgaagagaacagtcatatgtgagtgagtgtgtgtgtgtgtatgtgtgtgttttaacctttaagcaataaagctagaactactagtctagaatagttttagaaattggcatttcctatttgacaatttataaaaattttagggatgtcttcctttagcaggtgtttagcactaaaatctttggagacatgtgccttcattccaaatctctgtagattttcttctctgtcagcaagcctaccattggcatatagaaagctccagtgagggtcctctggcatcatcctaggacttgtcactgagttgattggatgtgacagcatgtcagatttcagtggcaagaatggcatggaggtgagcagagggttgtcactgtagcttttctaggcagtcttctagcaatttaatttaggaagatttaacgtgtggagtctttgaagatgtattcattgatccaggaaaattttgagtgccgcacctctgcaggtttcggtgattttgttggtgcagaaaacttgttctcaacataaattcggaacactgaaagtaatccttctttggaggaggacgtatttgatttgcggaggccgaaggggactgtgataggtagctcttggtagctttagcaagccatgatggagggagagccttggacttgagtatctggagagcaggtgcagcgtcgtttttatttttgcatcctgtccaatgctgggcacagttgttggcagattgtaggcactggatacatccgctatagaactcaagaaggaaatgaggataaaagtgatacttgttcaaaggggacctagagaactgaccaacagtttttggagacgaaagggcatatcagctggagactgtaagcaaggtaggagggataggagcagcatattctcattagccagctctgaagaaggctgtaattgcctttgctccttagttcaagaactagcaagggcctgcaatgttactagtgcaaatgtaatcacacttttttaaattttattattattataccttaagttgtagggtacatgtgcacaacgtgcaggtttgttacatatgtatacatgcactatgttgatgtgctccacccattaacttgtcatttagcgttaggtatatctcctaatgctgtccctcccccttccctccaccccacattttgacttttaaaaggagattttaggtgactgtttgcctgtgtcttcacattgaatttatacagaccagcattagagagaattgctgaatccaaataacccaaatgaaaaattttaactagagtataaaatagagcctcactcctctttaacttaattcttcgagtattttaaacccacagagctctttgtaagcatatgaatgtgcacttatatatgtctactgaaataacattttatttcatttcctctttgttatttgtaaatagttggcaagcaaacatagactttgaaaatgccatacattaattttatttctttttttgcatgaatatgagaaaaggtgatgttaggattaattacaccagtttttttctgagcatataccatgtgttgcactgtgctaggcactagatggtgagtcttaattcccactctcaaaagaaactgtaaacaaaaaaagtctcccaaacttaaaacacaacatattacacaccatattacaaggctgtaatagatgtagaaataggattttataggtgtacaggcaagggactcctagagcgagctgagaggcagggagttccagggaaatgagccaggaaaaacagcagggccagctctagaggagggccttgcttgctttgtaatctgtagcacatcagtgagaaatcaagcttttaggatttgattctgtatgagtgtatcttgcttggttttgacctctctgggtaaccagaaatcagtctgagtatatagaaatggagctttcatattgaaggtacaagcttgtatcaagcttatattttgtaataaaaatatgtgtactatgtagagctcccaaggacctgatgcctgtctccagattaccctgaagcagtctctgttccgatccaaggtctctcgcttctacccagctgttctgggaggattgtctctagtcttttatcagataactttaagcccctgcagatacgtagtaataaataccaacttcctgcttgcagatccaagtgtttgcttctctcaaaaaatatatatgtaatctgtgtgtgatatttcaacatagtcattttcttgtagccacttctgagatgtattgacatgacttaaaacacttgaagcagtatttgagtgctgtgcatttggatgtgttctgaagcagcactgtctgtgtgatggaagcatgcaagagttgtttgaaaccctttgtgtcagggcactttctgtgtaccaatgttaaatcttcctctagcagtcacatagcttaaagcatggctgtttagtcactccctgcctaaagtccagggccaggctctgactggattggtggagagcatagcaagcttgtaaactgatgagggagggagtggcctctttgcattttaggctaactccagtaaggaagaggagggctgcagggaagagagcctgcaggccgagtggtatatgatatttttgctttacccattcttgtgtgactactttgaagtcattttgttatgcagacactttagcactgaaaacaccataaacataagcaatctcaaataatgtgcagaacagacttggcatcttgagcttccttattgttgaaaccctttacttagagtggcaaccaggacaggggtaagggagggaatgggagtggaaaccatctggaagacacactcacataagccctactatgttgaccatacacagtcctctcagagaaagctgtcagtcactctaggcctggagcctgctcagtctctgacggggcttctctctccatggtctgaatcatcgtcctctgatgtccttttgagtcactgattttctttttaaaattaagacatggatttggctaagtcatgatggaacttacttgttttctatttgaaagtctagaggaagggtttccacattttatctctgttacaaatttgcaaaccttgtttgaataggtacatcataaaccctgggtatggcaggatgttgagcctccggaccacattaggatcatgtcagtcaagactgcccccaaaatccttggaactgctgctaagacatctatctctctggtgcctaagcaaaataaatgcattatacttataatcagagtactcctttgaaccatagttttgggggacagaactgatacaattttgctttgagttctaacaaatttcttacagaaatgtttaaatgtatgaagttaaatctggctacaagggggacaagattaggaatggagaaggagtcatggtaatgaaaaaaactacattttttgacagcattgtatcaagatggcttgtgaaaatgtcttgcttagatatagaaatccccattaagaggttcctgaaagccaaaaatgagagactcctctaagacaatggcaagctggtgatggtaaggaaagggtgactttggaaggtattgggtggctggatgaaagaagaaaagcaaaattttaatcacaaaaacttttttctggtcttagtattcctctcatgctttggggaaaggttttgttgttgttttcaacaggcaacacggaccagatgacttgtcctcacatcactaaattattttctagttagatagtacatgatttctgtaaactgagctcctgagggtagggacagtatcctttgtatgcctctgcctgacactctcctgacacataaaatgtttattgaattaaggagtactgaattatcttaaaattattcccagaatgcttccttctttacagtatcatgatatgaatttagctattaacaaggaagactcttattattcttatttttattattttgccaattcacttttctttctgcacaataatatatgcaagctcagacatttcatggtatatacacagtggtctgtgtgtatgtatgtgcaagtatctgtctatattcaggcatctcattaatattggtagatttaattgaattttgcagccactccatgaaatggctacagatttggttttcctaaacatgaatagattgatgaccttgattctgtaaggcacacccacagattcggcccccacataccttttagtcttgtattgagcacctgctgcatttcagaccaagggtactttatagacatcctctgcacagccctgtgaggcttcaagcacaaaccaaagcttgaagaagttgatagccttttaccgctgcccattttctctcctttatgcattaaaaaaaaaaatcagacagtatgtacttggggttccagttcaaatggcatctctgcctattgccttctgtgataacctgagccagatctctgcacttccacagtatatggtgctattcaggtccccagcacagtgctttctagggcagatggggcactgggggctgtcagagttagaggagagtgttttacatttgactcttgtaaacatgaaagcttcacttaaccaagcagtctaactgtttgggatgtggatatgacgtactttagatcagaatgtgtttctaagttaaagaaaaagtggcatatgaggtgctgctttttaaggctttaaatcagtagggaacatctgtctgtaaaaaatcagcagaaaccattctttttaataagtgcaacattaaatttagcattaagttgtaaaggtgattagcaaggtctgtagagtaacttctcttgggataggtgtttccatgatttatttgcctgtaacaaagtcataaaaatcgatcatgaaattaattgaaataagccatttttgccaaaaagtttggaaacatttgtgttgggaatttgtttaaagtgagccagaaagtctattcttgtagaccatagctgtgtaattcttttaaaaagagttgggtattaaaaggtgattgttagaattcttttgttaaaagagatagtaaaaatgctttaagagcttattgaatttgaattaagatccccaattgcatatttgttcttttctccaaatcaatgtgtttggttaatttctggacaggggaaatagcataatttcctccctgctgtctgcttcctcccagcctctttccttgcatatgcgttggggttcagattttgcagctttccatgacatgcgtctctcagtaaaagtcatcttttccttttctgaatatctttaggagtttacagatatgtttattaccttctcctaccccctttttatgggggaacttagatgtctttcttgttagattttaagcttctagatgacagattctcttaatcatcatcctcagagccctcacagtgagtacaacgcctcttacctcatgagtatccatgaaatcctttgggagccctgctcttctggatgacctcacccctgcttccacatactcttccatttcagttattaagggattaaatcaaggcagtggaagccattcatgcttcattaatttgtgagataacagcctgcagtagcaagggcagataaagaagtagaattagcctttttgcttttgacctcttgccaaaccccaacaggatgctccgctatggggaactttcccccctgtggtggtttcatgcctagggcatttctaggtactgttttctttgaagcaagtttcagaaggaagtcctcagcagcacaagggattgctactaaattccaaagagcggcttccaggccctcaagacagatgtttccttctctctgcttttatatcttaagttcagtccttttccttcctgggataatttagtctctctaaatcccttatctgcttcctaatgtgtgtctccaatacctggcttctgcaatccacctttgaaaaagagtcactctttggcccagttcacattcttaccagtccaatagaaggaaaggtgcttattttgttgagtaactcttagcaagctggtcctgggcggggcagacttgaggatgtccattatgatttgataatggtcaggcctccaggctagaaaaaattttggggtgtccctaagcttctttgtcacaaggattacaaataagagttctaaaatcttgaaagaaaactaccccttgtgttttagattattttctgtaactaggatgtgaactcctgaaataatgagctttgcttatttattctaatgctgaagtaggagagtttcttgtccaattatgtgggtgttacaggaaaggggtcccaatccagaccccaagagagagggttcttggatcttgtgcaagaaagaatttggggtgagaccacagagtaaagtgacaaacaagtttattagagaatcagaggaacaaaagaatggctactctatagacagagaagccccaagggctgctggttagcttttttcgtggttatttcttgatcatgtgctaaacaaggggtggattattcttgagttttccaggaaaggggtgggcaagtcctggaactgagggttcctcccctttttaggccatgtagggtaacttccagatgttgccatagcatttgtagattgtcatggtgctggtgggagtagcttttagcatgctaatgcattataattagtgtgtaatgagcagtaaggaggaccagaggtctctttcattgccatcttggttttggtgagttttggctggcttttttttaaccacatactattttatcagcagggtctttatgacttgtatcttgtgctgacctcttatctcatccagtgactaagaatgcctgacctcttgggaatgcagcccaataggtcccagctttattttacccagtccctattcaagatggagttgctctgttttgaaggtgtcttacacagggatttctagtttttaaaacatcgtaacacatgtgaaccattttatatacacataacattcagatagtatgattttcttccttagtggttacatttgactgccaggattaaagtatatttttgagtgacccattttaaaaaatgtgaaacgtggtatatgttgaggctgacctaagtaatctatgaaatttcacaaaaatattgtgagatctgtgttttgaaaacaagtatgattctaaaggaagaagaaactaaaatgcatattcatcatatcttattttaaagcctgactttcaagctttatttgatggtttactgttgtcattctaaaacagatgtcatcttcaaatgacttatcttgatgatattatttttgttttgtagccagtaaaaacaatccttttccggttatgtagccaaaggaaagcaacatggccacttatgtttaggatataagaatgtaaatgaaattagaaaattacatgttgataaaacagtcttggaaaaaaaatgattgtagctcattttctaagataattttcacctgcattctgccatctgtcatgctatggcatagcatctttgttatattgggatggcaactagggacttctttgagattagatgtataaaaataaaagtgcagtgccttaaaaaaaataagttgttgttgtatggtatgtctttttctattttatttcctttcaacctatctatgattttatattttaaatgtcattcctgtaggcacatatagttgactcttgtttttatattcattcttacattctctgccttttaattgcagtattttgtccactgacatttaatgtaatattcgacatggttggatttaatttgtcattcaattatttatttctgtttcttccctcttttttttctttgttttttgtttccctattcttggcttcttttggattatttgaattttttattcgtataattccatttactttttagttattttggctatagttcttcatgggttgtcctagggattataatataccttaactttttagaatccatatagagttaacattgtcccactttatgtgaaatgtagaaaccttccaaccatttaggtatatttaccatccatctcctcccagtcccatctgttatgtttgttttcacattgttttctttttactgcatagtgcacactttgcccattgtcatttattttgaaaggcttttctaccttttcttgccctgaagcttggactatttaggaatgtttaccagtgttgtggctagcaggggtaactgtaatgtgtacataaattaaattaccatgcttatactggcataggacaagactgcagtgaagccttccaggataaaggtacaaataactataaagacttattttccctaaagttttaccttaagatgtgataagatgaatgtctggtggaagggcataacactaacttgacaatgatatcaaaatgtcaacttggggatattttccaattgggcaaatgtttctgaattaagaatatgagacaattatagatataaagatataaggaaggccaacgtagtgcctctccttaagaaaactcaaggtttccatgcaaaacacaccatacataattccctttctccttttccttctcttccatgtccttgtggaccacctcaatcctgattgggcttagcgtgaagttagaattggggaagcacatggaggttaggcatttttaaaaaacacttttttgggggttagtttagaaacacccagttttaggactaaaccagagctagtaaggaaaagaaatagtggagacttgtatatctcaattgtagatgggaattttgagactgagctattttgagaggtttgaattccaaaggagaatttcctggtgttatttgaaagtactctagggctcaagattaaatgaaaaggaataataccattttgagagcttttgaagaaaatgacttgaaataagaaggtagaaacagttatctaagttcaggtaagtttcctgagacaaatttagttctgttaaacactttggctaatggagaggtccaactaccagttctcagaatggattagattgtctttggagaatgatttctcaagcaactctatagggaagagctggagaggctgaaacatggggccatgtttgaaagaacataagctttggatgtatttcggtgtcacagacatcttttctgctttgcacttgaggtgaaacaaacctaggaaggaaatggcagggtagagaacatggagctttgggaaaagaagccctgccattgtgtctgatggccatgaaagcagaaccactctgacgaacactctgaacagaaataagatgggagaggaacaaaaataccagctagacaattgtgaacatgcaacccagcattccaccgtgacagaaaataacagatgagccccaaaccaaacttctaaaacctaaaagtgatagatacagctgtctggaaacatacttagtgctagggaaagtttggctctcaaagaacagccgtgtagctgatctggaaatgaaggggagatggcctttaaacatcgggctgaccctattcttagagctcaactagaggacagaagaagaggataaaaccatgcccttaatgtggtaggactaaaactgtgtttactcccttacgctatcgtcattatattataattaaccattcatttctctgtgtggtaaataacaatgctgacacggtcacaaaataatgtgaagcatatgggtcacaaccgtttttaactaaagacttctctaaagatttatttaggttccttaattacagagtggcttggaagactggcatgtggtttcagtttatagttataaatgttggagctgatgatgggtacgtgctcttattgccagagagggagaggaacaagattgggagggggtttgtgttctttggggccctcccttttgcccccaccccttgtttttttaaagaaattgaagatctgtgtttataagaaataagtctgatgacatttatactgtccttgagatgggtatgccagtagttacaagcaaatttttccagtgcttaagtactttaattggtaaattttcacgtcactttgaactcagtggctctctagaatcctgaaagaataaatcccttttagcctttgtcttctattaaaattatactctctgttagatgaatgagaccctgtctttgaggacagcagttaagtatttcagcctggatagagaagaaaaaaataagtattcaacttaggttctttgagttaaaatgaactcacaacagggtgatttggtgatcttccaaagccttgtgtttgtatatatgtgtgtgtgtgtgtgtgtgtgtgtgtgtgtgtgtgtgtgtgtgtgcgcgcgccatatatgttactcatttttgaagtaattttgcattattttggaaccagtggtaaatataatgcaaagttgtagccctaggagcatgggaaaaaggtctgtattcaacaatacatgaagaattcagtgagtacgtattatatattggaaaacttcttttgtatttactgtaatgtgttttcctgcatttcttgccaatgatgataatgaaagtggcatctcaaaatattatctgaacattggaggagcagaaggggaggaaggctcataaaaaaatctaagcaatgctttcctttcctacatgaaggtcatagaagaaatgaatttcccattgtttatcattcttcatggagctcactccagtagggactttgccactgcttcgagagcatccactcattcatccatcccttcatttatgacttggtattggttacatttcatgtttatgtctctgtggcataaacatggcataaagattaattagaaaggctctgccctagaggagtttgtattctggtagggaataagaaggtgtgtacataactaattataacacacaaagattttctgacatttattcagggctttataaatttcaaagtgcttgtatgcacttttatttgatcttctaaagtatgtggctacattctccatgttggagatgaagacactgaagttcagccatggtaatgacttgcttgaagtcaagtaggtgttgagatacatctatagggcccagggaattgcatctgagatgttttctgcctctgtgttcattgttttccactatccccattatgcaatggtgcacagactggggaatcagaatgtgagagaaggctaaggccacaagcagctgtgaagcttgagcaaggctttggttgtgtagagaatggttgaaaggcctttgagagacagagatcagtgcacattgttcaaaggaacaagctagaacaagctgttattcaaaaaagaccctggtgtcaggatctttttattactttttttctgtctgtcgttttattcatacattcattcaacaaatgcacttagagtatacagtacttattatatgcaaggcagcagactcactgatatgaaggttacaaaataagactaggggtggctatccttgaggatctcacagtagttcagctggaaggtaagatatgctggcaaataattgtaggagaacatgatgagagagggaagaatgtgattcacagtatttctgggttcaagttatgactcttctgagaatgggatcatgggcttctcatgtcatctcttaagaccatgtttctttaaggaggctagcatttaatttgcaggtctgtgttgaagattaagtccaattgtgaatcctaggacactttactgggctcctggcacatcaaaggtgttcagtaaattgtcattatttatggttccgtatgcctttggaagaaaagccaaagtccttgactggtgtgaacagctctctgtgatctacttggccaaatatacactcttcctgtatcccagtctttcaccagtctcctggctgcagactggttgctctctgcacccttgtcaccctgtggtctatgcaaaatgcaaaggtgctttatcccagtggtcagtcgcaggcgttagctctggccctgctgtgtcacactggcagtggacctcagcaagttatgcctttgctttgtgctggtcttgttgtgagatttaaaatgactaaacgtaaagagcttggaggcagttctggtacatggtaaattggatattattaattccaattactgtcttatccatcctgcactgaagcttcctatcagctcttttgtttttcatttggaacctgcctatctctctccgcagctcatctcttatcctctcttcattatgctttgctttgccttccagctacatcgaactgcacataatccttcaccccacctccatgatgttttggcctttatttttgtctaaaagacatttgtcttgctcattcattctttaggactgagttttccacctcttgagtttctctgagtccattctccacccctttgaggtttgtcttgttctgccatgttttgcacatacctttatcattgggcttaatgtattggctccattttctctttctctttctctcctccttttgacggagaactcctgaaagaaggggtcaagcattaattgtctctacactccagctttttcttgacacatagtagactctcaacaaatacttgttaataaatgaagtgaggactttacctattttaaatacattgtcttattgtcagaatcattttttcaattagctagaaggggcaaaatttactttagtaaattttgaagtggggaagagcaacaggaccactgctctggccttacttgatagaggccctttgtcatcctaaggcagggttagaattttgggaggcttgggctggacaaaaaccctggcaaacccaattttgcctctgatggatcttagagttgcagtcatttgtttgtaaaggcagtagttctgtatttaagttattgtagtaacatcagctatttggtatttgataatatttttcaaatgtttgaaaagatttttttccctcatattgaaacttcagtgtatggtcctgaaaaatctcaacgttatccaattttagacatgtggtgtaacattttctccttgtttgtctgagttacctggattttagtttaacaacccataaatgtagcttgctgggtttataaataaataaattatttatataaataatttcatataaattttatataaatttattaaataaatttatataaattatttatttatataaatagtaaatattatataaaaaataaagcatatcattagagtacaataaaacagtactattttggttaatagagaatacatggaagaaggtaacgtgtcacaatggatgggtttatttatttatggattttaagaattcaaaggaaataaaaggtgatagcttgctttccaaaagcatatcacagtggccctttaaggagcttgtagttccatctgataaacacataataatgatctgaagtctaaggaatttttttccattatcccctgcagctttgccctttcggatgaagcatacagatccctacgagatcaagataaggaccaatgtattctcattactggggaaagtggagcaggaaaaacaggtaaggctcctaccaagcaactctgcagaaggtaaatgctgcacagaatgacaacagcaaagaggaccagtagggcctccttagcaagatctgtcgcagggccactgtgagggtgcttctgcaggaggatactggttaggaacacagaatgttctctggactccccagagaaacaagatgcctatccaaggggattccaaccaatatgaagtctagtgccggattctagacctttttagcgtagtctctggatggtgcaagatctttttacttttctcccaagacattaaacctgtgtgctgttacagattcaaactgcttccccaagaatgccaatttatttaggttttaagagggtacaaacacactctacctttgctaaaaagtgagggaagataccagaaaaatgctaacattttactcaagagttttcctctgaagcctgaagaattgagatttttatatgtattttttagacctggcaagcttcgcataaaaaaaccctccaaatggaagggttatgcttttttccccttgtgcttttaataaatgcaattcatatgattggtggtcttgagtgagaaaataactttacagatggtgcccagctacctggaaaagattcagaagagccacattctctgaattcaaccttagaaacgtttaaagctgctgttatcagtgggttttttttgatggaactgatgagtctgtggaggaggaagatggtgagggagatggtattttcgtaaagtttcatctgtaaaatgcttttgttttatagataagaatatgataattggtcaattattttagtattcaaaggtggaattttaaatgtttctattctacatggctggttagttgtaacatttacacattttgagttcccattgatcaagagaagaaaatctgccataggtgttgagtcaactgactgaatccattttattcacaagctcttagaaatatttgtgccttgaaaggctcactatctacatcgaaatggttttccttctacacctactctttactccacttgccttaggcgtaactcctccctgcaccccatgcagctgaagaaagagtggttagatgaatgtgtccagccccctttcttgagctctttggagacaccgagcaccattgttttgcagggctagccaagttctaggctctaggtggtcagaaatgaagggaaaaggactggcatgtaagagccttaggtaacagaaaacatggtgtcatattgttgaagggattttagttataaaccacctggtgtaggctcctccacatgggacagccaaactccttttgaagtgatgaagtctcaccactttgaatggcacccccctggatttgttgtacaggttcagctaacaaaattcttccttacctagagttcaattctgcctctacctatttgtcttcagtctgctacctggaactttaccatatttgtcttccttctcctctacaggacaatcacttagttatttgaagtcaacattttatctttctagggctaaaaatcccttttcttcaaattttctcattttatacacattgatttaattcattcatccagaaaaaaaattattgaataccaacttagtgaaaggtactatactagggactgtccttgcccttatcacatttcgtttagtaggggagataaacaatagctctttacatagacatatatgcacgtacctatacatccaaattacatgcaaaacataagtggagtgaaggaaaatcacatggtgcttatgagagcacattacaggaagaattggatcttacaaatctctcattatcttggtcctgttgttctggaaacatcctaatttgtcaatatgcttcatgaaattgcataccaaaaaataaacagaatacttgagatttggtcctggttgtagtggaactcttatcctttttctttttgagacagagtctcgctcttatagccctggctggagtgcaatggcgcgatcttggctcactgcaacctccaccctctgggttcaagtgattctcctggctcagcctcccaagtagctgggattacaggtgcccaccaccacgcccggctaatttttgtatttttagtagagatggggtttcaccatgttggccaggctggtcttgagctcctgacctcaggtgatccacccaccttggcctcccaaagtgctgggattacaggcgcgagccaccatgcctggcctattatccctcttaatgtggactctgagcttctattaatataaagcatgtattgactcatactggtctttaaaccaagtaagatattataggatttttttttttttcacagtaacttccattaggtcagatctgctcaatcaactattgatgaacaaaattattttaaacttacatgcagaatattgtatttatttttattaattttggtccattgttacaacctcttgagaagctgacaaatcctgatgctttcccttcccttaggattgctgtcattttgctgggtgataatgatactagctaacccacgttcagcacttatcacgtgctgggcggtgtgcttatttacatgtatgagataagtatttttgttatttcagtttttatgatgggaaaataggaacacggaaacattaagcaatttgccaaaacttatacagtgaataagtggcagagctgggattttgaatgcaggtagtgtagttatagagtccctgcttttatccactgtactaagctgcatctctgtaccttgaacatggtacagagtagttcttgaacatgattctttccgagtgccacactactttgcccatgttggtaagtctccttcaactagcctcccatgtcttcttaagggagggattttgtattatgtttctactacctaatttaatggctgccatacagtaggtagtcagtacatatttaaataattgaatgaacatcatgtactaatccaaggagccagcctcctgtctttatttaagtaattgacaaaaacactgaataggactgggccaaagactgatccatatgaaaattgccaggtctcatttaaaatatgtctatcttactaaaaattagttgatttgcttagttctgggtatctttatctttctccatttttttccttaggcagtctcaactattttccagtaacgttaatgtgttctacatttacactgctagtgaaaatacctcttggctgatctcccagctatgtatttactgcctgtctgacatctctacttggggtctaacatgcatctcagactaagcatgtacaaaatggaactcttgatttctctctttaccctcttataaccaatctttctgatctcaataaatgagaccactagtcaacctagttatcacactagaaatgtttgttatccttgatttcttcctttcctgtatttcccatatcaaatccctttcctaattttgtcagttctggctctagaatatatctcataccaggctctctcttccttttctttttgtccacatggagactcacaagccaccacccattatctctcatgaggattatttgtagcagtgtctaatgggtttctctcctttctctcttgattacccctaattccattttacagaccccagtctttgcttgttcaaatctctctctctctctttatctctctctgtctctgcctctgtctctgtctcttaacctgtgggaaactttacaggacatgggcatcttgagaaaatgtttttaccccttccatgtcactaaccagttctttcaggtgaaacagaatttaattcttagaagcagtacagcttcttgtttgtctctaggttgacaaatgaaaatggtggcaaggcaagttagaaactctgttccttgctgaaggcatctgtactgatgctgtatctacgcccacccctccccccatcctatttgactctatctacaagcacacatattcacttcatattgcttcatttttattttcacttggaagaagaaaagaaaatattcctaagcctctttcattcttacattctttagctttttagtcagccttctttgtgactaacggtttttttttttttaggatattctaattgtatcaattcgttcctaaatgagtcatcagaagtgggttgcggtcattgttttgatgggtcttggccagttcttcatctcctctggaacatgtgttctgagaagacagcacgtccactaattagctatgtcagtatgtgacatccgccttctcagagagttcttaacactactacttcctcctggagccagattccatctcctgatgggctcatgtatcttccttactgaaaaactgagtggaggttgctagtgctgtttcagaggattggcatccatttttcttaggaaaaaaaataactaccaccctatttctctggtagaactctagtagtaaaatggagttcattcttcttttttatagttttctcttgttatttttctgcttgacaatttgttctattggtttcagtgcccaaatcaccacttgaaatcctcttctccttgtcatcttccctggatttagtccttctggggatcctgttgccctttatcagaagctggaaaatggacagcgcttcccagggcttgtcaccctttcctctggtagtgccattgtgtttacagcacatagaattaggtgctgcttcagggaggaggctggaggagggtccaacagagacgctagagcattgcttctcaaatctgtggtgaagcaccagttccaaatctcatgttcatcattactagaaaaatgaaataatagacaaaatagagcatttaaaccttaattttttcttttagtttcaacaggcaaaacaagcaaccaaattagtacagaagcttttaaaagcctacttgcatgtgtagatcacttaatagtctgtggattgaccaacttggagtcgtgctggtccttggaccatacttcgagtaacactgcctagaagtcactcaaagcatttgtgttgtttttgagctactgtgcttcttggaccctgtgatgaactatcgtcttgggtgcttcagctgtctgttatcactaagacgcctggagccgggaggtggataccgctcctgagagtggttcattttgaatacccacttagctacatgcttggtagcacctagcccttgagtccttttcacttatggaacccaacagcttctcctacctctcagtccactgtagacatacagtggtttgctgacttactctattttctttcttttttaaagcagtggtacaaaaactgcttaatattttatgacggttttaattgtctttagtctatcaaattgagtaaagccaagaatattgtgtgttgtttaaagtctctgttttatggagattacttacaggaaaataaaatgatggaagataatatagaaatttcagtatatagttgtacaaggaatttggagtgggggtttcatctcagttttgagcagaagagggatgccaggccattttgaaatgtcatatcatcttatgcactaaaattgtttttgtgtacatgtgttcattaaaaattttgatttagtaaataaatgaaagaagatgattaacatttattgaaggcctggaatgtgctgtgtgcttgacatataatatctcctttcaataaaagtctttacttaatagtttgtatagaaccaccatgtagtattagagggcttattttataagaagtaattaacttaactgggtcataaaccctccttggcagatgatgatgttattggtcttaaacattggagacactcttaagctgcggagttatgtaacatgggcacttagggagaggcgtgaactcttttgagtcctttggggtgctatttaattcattactgctgtgctaaatgaaaaattcatcagacctcataaaagtgcccatgtatttttaggcattgaactcacaactcactcccatgaatacagatggtttgtggagaacctttcaagcactgatgggggcaggggggcagaatatgagggaaccatcaaaactacatttttccaaggacatcagagtaaatctctgggcctgagaagatgatcccaacgttaggaaacataattatttggtttctaattttacagttacatcagtttctaggaactcttcagccatctgctagaagagttatgaagcctgccttgctcattaagacctttggttctaaaccccaaatgaccttatgtatctgcagtggttctccaactggacagtgacagagatgccactgacttactgtagcctaaacattggcgagcatttcacagtgttgaaaatacccacactgaagcagaatagataagtgaagtcaaggccaaaatgtagtgagcttttgttttgtttttcccctgtgtgagaaagacccctctccatccgtgtgtttaatataaattatcagagattttgtggccctctttcagaagaggatgacatacaggcttatttcaataaaaacatcaccagttgtgacttcccttgtaacaaaggctgcgtctctcattgcagggcccatgcatttagtactctggaacacttcactgctgcctgttagatccatttggatgtgcgggagctgggttattttgcagcacagtagactccagactgctaaaaggtggtttctccaagctgtagagtgcttgttttgttgaacacaaacatggcctcattgatttaggcattcactctttagccctaaactctggtctagggctctgaaccaccagacctacaaaagctcaattcctagaaaaactttggtgtcttaactagagagatagagaggtaaagaaggagataaataaatgtgtacgaataaatgtatggccctctctatatgccatatgacctgtagatcaatatgcgacatacatgatattgcctatatctatgaatttatccatagagacctgttactcctggataaatttattagaagctctgtgaaaaaagtgcacaataatccttgcctattctcaagccttttttcccccaatgcagtgattgaatccatgtggagcctgctccattaacatagataggtttaggtatcttaggcatgagattcccatccttttgtcatcatgacaattgtctttccttgaattgttttcccttcctcattcaccttccgctacttcacaatgctttatttcattaaaaagattattatatatgaatttatataattctatgttgtgtgataattacatgataatacatattattcacagtacagtgcaaggtgtcagagaatacagaattcaattagttattcttacccttacaggactttaaaatcctcacacatttaaactgtcatctgtacttcctttccattgtttgtagaaattaattctgatctagatattctgatccagaagtattttgtaacaggccctttgtccattagtgaggaatatgtgttaaccctaaatgttctgccattttctgatgagaagagattttgaccccagaggcttcatatattttgttagtccagctgttgatgaattttaagattcaagttacattcaaacatatatatatatatgtacgtaagtttacatatataaagtatctatgagttagagaaagtgatgaaccaagaattgattctaaacaatgctgttacattttgtctattttaaatgacaatattcttatatttaacagtcaacataattcaaaaaccagactttgaaatatggtggatgatactccatttttgattctcctcagaaatgcagtttttcattatagaggttattatgtaaaggtttgatttgtataagtatataaatatttgaatacagatccaaatttatttgaactttagcaccaaagagtcaaaaggaaatgaagcacaaagtctcatgaggtaactattatttccagtttccagcgtggtgaaatattatgaaaacagttccttaaagtatgttggaccttgtaattcatccttactggtttattaatttctctaaagtagtgcctgtgtaatgaagtacttgagttaaaggtcaagtatatgtcaggaaaaaaaaaattataagagttgtctcttttaaatagtgtgatttttttttttggagaaaatactaataccagcttccaaaaatgacttattaagatgagcccagtagtagaattcttgaaaatagttaagaatctgaagatatttttaacaacttggaaataaattattaaaacagcttgaactttattctcaaactatattttaaaattttatttgaattgcttaaataggttttaaagttaataaagtgattcttaatttcagtttaaatgaatccatctttatatgccaggagatattatgggtttatatatactttaacagccaagtgatgtaagcctgacccaaattccaggagatctgctcctggtgccattttcaaacacatttgaccctgagagaacttgatcccatcttgttctggccattaaaaaggtctctgagaggtcaaatcaattctagtagccaccaaaagattctcattcttggttgattttccccccaccaccaccctgctaaagcagttgtcctctaagttcatcctggaccagaacaggttttcagaggactcaatgtagccgtgaatctgaattttgaggttttgaagtttggccacagtaaggtccataattaccagaataacaaaagagcctgacctaaactttatatatttttggtcagtttacctaaaagaaaacttaccttttcatctaaaatgtgtgagtgtgtatttgtgtgtgtgtgcattagtatgtttgtatatttgccactgtctaagacagttattttgctgataaatgttttcagtctcctagtattacgatggatagataggccagaaatttatgtcaagaaagaaacatatacataatatatgtgagagttcaggtggggatggggaacaaagaatgccactgagaaagcagaaacatgagaaagcaggcctggaggggattgcttccaaggccagactacagagttggatgcctgggtgattgaagagagctgccccagtgctggagactagatagcaccggatgttaggaacctgctaggagggcagcctcacctgaattgaaattgaaaggcagagagcctagaaagtatcctgaagtgagcagggaagagctataccttggactagagggtagagggcaatgtggcccccaggagtgaaatgaaatataatagtatataaagtctttgtctgtaagtgatggctcaggacagcctgaatggtgtaacaggattatctatgtataattcaccagcttttttctagataaaccatgagaataatggaaaatgtagttgaggaactttaaatgttggtggttgtgttatgtggacagtaagtgccctgtaaaagaacggtattgcaaaggtggaaagatggttgtttctcagttacagtctttaaagggagacagcagaaatcaaccacacagatgaccagacaacctatttggattccttttcattacccagaaagcaaattggagagagttacctccaaccattgaagaagcacctaatgtcccaccatagttctgtgctccatgagattgtttacttcccccttaatgtatttgccagtactccagaaacagacatcttaggacttgagagctttatgtgacctgcatagattcttggtcttcagtggctcctattggttgatgcttttaggttgcgcaaaagccctcaggaatacgttgggcagtgtgctcaaagtggcattccaatttttcacgtattattttcccaatggtgggagatgggactggaatccacctgcaggtctcctgtgagacagttaagattgcctcattatacctgtaggcagagagaccctccaacttggaggaggctcacctgcccactgacagtggcagtagagcaaagacttgagacaaagcaggatgtggagagactggtttccttaccttaactacccagaccagggaatatgttttcttctgccaacataaaatagtcaagcattttctgggtcccagttacggaacattagaacaactaattaggacagcccaatcaatggaaaacagattccatagaaaataaattagggaaacagcattctagatccttttttagagttcagcagtgcacgcgatcatattaaaagctctgagaagccttttgataatgaaagtggtttcactgcatctgactcactgtagctccacatccactttggaccttattttccttaaatatctattaacatttcttgaaacttagtgttaaaagaatcagaagctaggaggcagatgccgagagaggggacacggactgatagggaagggataaaaccaccaaagacatgtttagtccccagtttgagctaaaaaatttttaggtggttttatcctttgcctcatgtggcctattctttagcagctttagtaacggggttactagtgaagcctattaagactaccatgtctggaaaaggctgcgtttttttgttattaaatccttacattggctgcttagtttttgaattaagttgaagaataatgaatttggtctaattatgagcaaaccagttttttggtttttggtgtttttttttttgagacagagtcttgctctgttgccaaggctggagtgcagtggtgcgatctcagctcactgcaacctccacctcccgggttcaagcactccttctgcctcagcctcccaagtagttgggactacaggcacgtgccaccatgcccggcttatttttgtattttagaagagacagggtttcaccatatcagccaggctggtctcaacctcgtgacctcatgatccgcccacctcagcctcccaaagttgctgggattacaggcgggagccactgtgcctggccgagcaaacgacttggaacttgtgatttggaacatatctttgaagaagagcagtcttttaaactttaaaaatacgtttggtaaagatacccaggttatcaagttatttgtggcttatcagtatataatataataattatatataaatgattgctttaagaagataattctgatattttgttggtcatgttactaagcagtttttttaacagcccagtgataaactttaagcacagtttttattatgtctgaattaatgacatgtcactgaatagaaagcacaaatattttagaaaggtatccaaaacattatttactcctctaggaataaagacatttgaaaatgccgttagtgggtcttctcccacatttcctcctccccaaaaagattttttaaatttctgtgttattgattaatatggcttattttcatccacagaggccagtaagcttgtcatgtcctatgtggcagctgtttgtggaaaaggagcagaagttaatcaagttaaagaacagcttttacagtccaacccggtcctggaaggtaggatgtgttatgttcattaagtcggtgtgactcaaacagtagattgagttatgtgggtgctttgagtacctggtctgctgggaggtattctgggagggaagaggaaggaagagattcaggccaagacctgctgagcaaataagccgtgttctagaacctcttggcctaagtgtttagcagaatagtttactaatgtaaaatgggcttcctcacttaacagtcacttttccccactcaatttttatttgaattctttaaattttgattaaaaataatcaactgatcatttgcatatgatggtgcagtgctgttttattattcaggataacacctgtggctgattatttttgttgttagagaaatgagggctcaccccgagaaacacttaaggactcattttttccagagtcatagaaagcctaaacctgactggagagtgctcaaattctctatttagttctctgtcttagcttgggctgccataacaaagtacacagactaggtggcttcaacaacagaaacttattttctcaaacctctagaggctagaagttcaagatcaagctgttgtccaggtagattttattctgaggcctcttttcttggcttgtaggtggctgccatcttgctgtatgctcacttgaccttttcactgtgcttgagtggggagaggtgagagcaagctctctggaatctcttctcataagaccaccagttccatcttgagggcctcacccgtcatgaccacatctcaccttgattccttcccacaagccccacctcctaatactagctttttgagggttagggcttcaacatatgaattttgcagggagataagcattcagcccataacatcatcagaaaacaaaaccagaaatgagtttccttaatgccatggagaatggcatacaacatcagtatgaactaccttggcattggaaacagtatatcaaagtctttccctactgatggcaagctattaaactgctttatggctgggcacagtggctcacacctgtaatcccagctctttgggaggccaaggcgggtggatcacttgaggccaggagttcgagaccagccttgccaacgtgatgaaaccccttctctactaaaaatacaaaaattagctgggcgtggtggcacatgcctgtaatcccagctacttgggaggttgaaacatgagaatcgcttgagtctgggaggtggagtttgcagtgagccaaggtcacaccactgcactccagcctgggcaacagaggaagactctgtctcaaacaaacaaagaaaaaaaacttgttttatattgtaagcgacagagggagactctgtctcaaaaaaaaaaatgctttatattgtaagcatgtctttactgtcacttaacatatttgttatggtggagtaaggtttctcagcctcagcagtgttggactgcttacatgttgctgtggaagggtgtcctgtgcattgtaggatggcctgtcctgtgcatctctgacctctgttagctgccagttgcacccctgcccctagttgttacagttgaaagtatctccagacattgtcagatgtcccctagggagtcagaaccacccttgattagaatctctaggctagataggtagtttggtggaaacttttggttcaagtcatagaagtaaagtcatggaaggatgagattcaacacggattaaagcagaactgctttggggtagttttttcccagtatgaagggttaaaaccctgccctgttgtcgtttgtactcaggctcagcctctcctgccctttcagagaggctcccgaacactgagtattcactgtgaccccaagacacacttcccatgcttcagtttcaccattacaaggacacaccatgcatctgtatccccagttagtagcataagagagaaatgaaggcaaatcatctattatgctgtttttgatctttcctccattgcaatatcttaataacgaagctattatggaaagcgatatctctcaattttattgttccaatatttgactttttgtttattgtcttttgcttttaagttggggtgctatacatttgctgtatttctgcatatgtttattttaagagtgctgtgatgtaaaggagaaatgctgaggaatgctgtagcctgcatctgtgactggaatctggctctttattcagtggtatttggaactaggctccagtgcaggaaatagaagaaatgtctactgtgggcatgcattatcttttatgggaatgctttactttttagctggagctgctactgtaaatgaacatttagaacaatgaactttaaaaaaaccaattgaggaatgtgtctcaagtgttctataatggaacacttgctttttattctgtggctcacaataaaaggctttagtgtttagggttgtgtttagtaatgtgcaactcagatttgtttgatgaaaagatggtttatggcttgcaaatagcaccctgaataaagtttctttgaagcaattccttcacttgcccctgaccttcaagccacaataaactgtcctttatgcatcaacatctctagtcggacttggggctgtgcaagttagctaacttggcagccctgcatgttcacacccaccacaaaagactagcctgtgaaaacacaagaaatgtcatcgtcttcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctctaaggcaaagaactttgcctgtgttgactttgtaaatgttgtcttaaccaagcttgggcaactatctttttaagaatcaaaaacacagccgggcgtggtggctcacgcctgtaatcccagcactttgggaggccgaggggggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccgctgcactccagcctgggcgacagagcgagactccgtctcaaaaaaaaaaaaaaaaaaaaaagaatcaaaaacacgaaaaagccactccacacaaaatataatgcatcaagtgtggctgctgaattaccggagttaacataggtaagcacacaccctctctccttgatcagagacttctgactgctttcaaaagtcagaccagattttagcccgtagttctcatttgaacactcagtagtctaatctgctccctgtttaatttgaagaagttatggagacctctagagatttgatgcctagcctctgattccagaagtttatttctgttcaccacattattcattctagctgccgtgtggcccctggatcccagtaacagactgggcaggtgggaggcttggtagaaacggaggatctcatgcctcttcccagacccattgaacctgagtctgcactttatcctcatgtagttagtttgcacattaaagtttgaaatggtaaagatgggcggggtggggcttccagagtgtcaaacagggatcgcctctacttatacaacttatgtttaggctacttaatcttctactaccatggcccaggttaacttgctcctatcttatgcacaggcttggtgaaacaatccttttaccctatgactccgtgctgttccctgtgttaaacaagagcactgtgtgtctggaccagcgtcaaccatggggttcttaaacgctctcatttaaaagggagtcctgtgagggatttgtctccaggaaacagctaagattggaacatttgtattttgcattatgggccaaattgtttttctttgttgtctggaaagtttcacctaggtctgatgtgcataaactgatgaaaccatgtagcacttgtagcctattggaaatgactgttgtttccaaatctcttattcttcctgtattccagagctatataattaataatatttaaatagctttattttaaaattaattaaacaatttaaaggttcacatgccattccccatgatctggaaacttcaagttccataaagcctttgataataagtaatctctgaaataaccttattcagtgatgataatcctagaagagcatgaagctttgcttcctggtcactcaattgactactctctagaagtgttaaaaggtgttgaattaggtaagattaagtttacagtaatacttgaaaaaattccatgagtcataggaatgattctctttttctatgaacttgtaagacatggaagctttagcaacttactaagacttctgttaagtatatttctatggaagttttggacagaaatatcattgctacaagttgtattttccagaaatcatagatttcaaatactgtatttgctttatctttctgcttgagattattattatttttttaaccatacatctgtttctttcctactagcttttggaaatgccaaaactgtaaggaatgacaactcctctagatttgtaagtatttgtataagcataagtgttaacactaatatttagctcatgtatgtttaaacaaccagtagatgtttaatatttcttaatacacacatttttaaaataagaggaacatcatctctattgaaacacaaagttctataaggactcttgatttctggaattttccttttgaattctttttggagtaacaagcaatttttatcatgttttcttgacatcttctatcataaaatcccataagcaatttaaatgaggctatttagagtaacactttgcttatctgagtttggtatttagaaatcaagaatcagaaattaagagaaagataaactgggtctcaagtttagggttagggtgcaccgtaacccttgtcccttattcagtgggtccagaaaggatgggatgtattttaaaattaatagaggtaaagtccataggcttggcaacaaaagcaagcatgtggggtgagcgtggggctgtagagtagaactgaataataaaaaccaaatctatttggtgttttgagcttgattgagttggaaaatgctacttctccctacagggtccatctttccagcctcatcccccactactccctggcctgtgccttgcatgttgacgcagtgggctcctccaggcgggccatgctcttgggtgcctctaccctttacagagacacagctgcctggatgcagctgcaggaaatattgagtctgatggtggtgttttgaaattgatgtatacatttttataataaaagatcatttgtttaatgaaccgtcttctcacataccttactgattgccaccagggacaattttgatgatcttttatgcctccttatgtgagacccttcctgacctttctccaccttcttcttttagatcccgtttggctctttcctccttaaggttattttgtgcttaaggcaggacagtgacttcaagggagatagttttgatagtttagaaaatggcaggctaaataaggttcctaattccaaggctgtgaattttttccatcagattagccccttaagttgttataactgatttgatctgtgccttttcctgttgtggtaacatggctaatctcattacataaatagaattagaagtgaagtgtgggcgatagaagtaattctaatgaccaagcttctttatgtgatagagattttatttttgctgtttgcaaattacatacacacacagtatttaatatttgcaaatatatttagtctatagatcacaaaaatgtaaaaacccatattgcttaaaaggctattactactcagtgatatttgaaatctagtgaaaggcttggcaggtgatttggcttattaagtaacttcagagaaatcctattataacacgggtattaggatatgagattaatacctgattatgggctaaatcatttcatgcccagtttttagcagtttctctgctttgtggtctgtgacttgactagtaatatacccatgttttaattttataggaggactctactgtatttaaagttactactgtacctaacagtggtttatgtacttgtactccggggaaattgcaatgtcttcgacttgcaaaccagtctgtgttggtctggttaacctggaatgaattccttgacctcttcactgagtagtctgatagaccctgctatgttgtagttaatgcttgctcatcgtagctcacattttgaaccagtattcccatggagatgcctcacagtgtccgctccccaccacagcagctgtagtttgacatattgagctacgagttatttctgagtggactagtgacatgatcagaacccagcttttggcgagtaatcaggaagtggcttagtgggaatagtgtcattccactatcaactgaattctcagggctggccactcattggtttatccctggttgtcttccttttccattctctccagtgtttattctactctcctcaaacatcctatttttttactctcagctcatgatgttacgcctacttcacagaaatcaccatcatcatcatacaggccttcaaactgagttaatcctgcttcctggtgcctgacctatatgtatgtctatgtacactccttttacctaggctctagattctgtcgcctcctgtggccagggaccaccttctgtcaaaaggatcccctcttacatggtcaacctctgactcctttgacagagtaaccattctttccctcctttgtagctgcttcacctccttggtcccccaccttcttggaggtcctccctgtacactgagtggcctgggccacatgactggacttttttttttcctctctcatctcctgcatccaacctgggcctgttcctgtgactctccgggtagctctcaattctgtttactttttctctttgactacttctacttaaagccaccaacatttctccactaatcactgtagccacctcctgtcagctacatcttctcttgcttctttcctgttcattccatgctagccagggaaatcttgtaaataggcaggtttgatcatggcatccttgtttaggagcctttaaggacatggctttggtgtgacgagaatatctcaaagtaatcatgtgctccaacttccctctccagccttgtttcccactcatcctcacggttgccaattcttatgcctactccttcctggtctcccacctccttgcccacctgacttctgctgatactttgcaattaagatggggcagatttcctactctccctttgttcccgcttctttggcatagcaccaggacccactgtaggacatatcctcctagactggaatatccagttaacctgtctcaattcccccgctagacagtaagctccttgaaggcaggagccatgccatgctttcgcttgtgcctacttcagctttaaggaaatggttgagggacatatccttatgaataagtgcagacctaaaagggtagaggacccatgatgatgaaaaaagagaaggtgcaggagcatgcataagccgataaaaaggcacaaattgcattgttgactgagttccatgtgattgtatttcttctcccttaccctcattttgaaaattaatgagttaaagtaattcttaggacatgaaacaaaactaaagactttacttattagatcaacacacacttttccaaacaagaaacagctgtcacagttactctgttatacttgttactctttaggcaattatagaccagttcttttaacaatcagaatattaaactctatgtgtgtttctgtgtgtttaagatactatctataaagtgtaaaatgaacctgcgttatatattgctattataatctgggtgaaaagccaaaaacagtaataatgaccagtgtgattctgacctgttcataacacataatcttgtatttgatttgagtagatataaaaacagatctctgaacgtttcaattcatttactgatatgtttcaagttcctagcaatggcttaaaacatattctgccaataaaaaaagactatcttcccaaccagtctgtatacacagacaacttatttttcttctgtttttatttttgaattgagtacatatcctccagaagtttgaaaaataatcttaaatggaaaaatcacatgatggctgagaagatttgttcctaaattagcagtgggttatattagctttgaactaatggggtatttagtatgaattatttatggaggcatgttgttttgcatcgtggttatataaactgtgtctttcttagttacatttaaacaaatgtataaaaataagggcttagtctgctgttctctaagaagtacactgagttaacattttgagatgaactagaaaactcacaaaatctttctttggcagggcaaatatatggatattgaatttgactttaaaggcgatccactaggaggagtaataagtaactgtgagtatttttcttcagtccttgtaaagaagttcagaatactaaaacatatatttatagtagaatagtttagatacttgtgtctttgaggcataagaatatgtttccttgctttatatttagactttaagctttgcatttcagattgttttataatagaatgtaatttataaatctttttaaagatcacttaacatctttaccttggaaaaactttttagaagtttgctaaataaatatttgcgctactgttttttatattctataggtctttttaaaatcctataggtctttaaggcaatccagtatgaaaaaaagatcctctaagggttattttctttaacaaaatgcttatgataaaaaaaatataaataattggttttaaattataacttttgaagtaatatttattcaataaaaggagtagacctgtacttcagtcttattttgagaaatgttgcttctcttccagtgtatttaagtgattggaatgtgatacacttgttaggtaaaacagattttttaaccttctttagacatgatttgtgactgtggaagtgaaatattttatgtgaaaagttaaaaaaaaaaaacaaaaaaaacacaatcagatgaggtctgctcattctagcccaggtgcagagttttctaaagtgggtgtatgagtgccacacggggttttcagtgtctcttgtaaaaatgacagtgctgtcagtgctttggagttgtggcacccacagcacaaccctgatgtccctgctcctcttgactcgtggttgattagtttggaaaatgtaagatgatgactcagggctttgtgcacctcagccacagtctggttatcctctgagtcctctgggttttttgaggaccatagaactgaaccttctcctgcccttgcctgcctcaccatcccatggtgctattgggattgttagaatgaaaaaatttatgtttagacctaaaaaaaaaaaaaaagaaagttgactgaagtatccaaagtgtgctcatttatttttcttataacagtggcatttcgtcttcaaaggaaatgttatgctgaaccccaaagaaggtaccggggtaaaatgagacctgatctggttgaagaggagatgggtagcccagaatcccggcactctcagatgccactgagatcttcctgactagccctagcagaagaatgccatttgaaaattattatttagtaatttggtcaaactatgcagctgatttaaaaaaaaaattaaatcatgattcagagagtaaccatctagggctagaggtttctcatctttaaaatgataggattgaattggatgaattccatggttcttcccatttccagcattctgtagttcttaaataatttaacttctggctgggcgcaatggctcatgcctgtaatcccagcactttgggagactgaggcagggggatcacctgagctcatcagtttgagaccagcctggccaacatgtgaaaccccccgtctctaccaaaaatacaaaagttagccggatgtgatggcgcatgcctgtggttccagctcaggagattgacttaggaaaatcacttgagcctgggagctggaggttacagtgagccaagattgagccactgcgctccaacctgggtgacagagtgagaccccatctcaaaaataaataaataaataaataagtttccattttagtttgcccacctacacacttttgtatgccatgtgttcggattgtccatatttataagaatgtttaattattagagaaatgccttgaagagaaagttttaatatgaattgaagttgaatgggatagtgctacctaagttaaatgatttcatacacaaaatatgggagtaaaagtactcatgcaaaccacatacgatgtaaccaaaggcaagtgattataacccctgccaaacttgttaggaagactctttttacaatatatggcagctgatcagagctatccagctagtggtttgcctcagttttaagatcaccattttaaggaatgattaatatttattctgaatgatattcatgagcctttagtgctttctttttacaagacaaattaactctagctataaaattaataaaacactgtttttaaaaatgagagtaggtttactatttccattacagaacttatagctgaacattttggaatgatttaatcaatattactcgaggattttaggaaaataattcaggatgattttattattataaggattagaaaataacttcagttttaaattttgaagtttaagttctaagcacaaatgtcttcttgtcccctgattcttgcagtatccatggagaataaatattaaacactcagttcttttccaattaagattaatatatcttcatgaatggagttcatatggtgtttgttaccatttgttcccacagtgaaattatattgaaatttgtggtagtgagaacaccctggtatttaagagtatcctttgctttggagagaaaaggaatacattagtggtaagagcaggaaatttcatcctgtatagagaactgactcatcggtggtcactgggagttgctgccttctggcagaagggagtttaaagcaatggataaaccaactggtgttctctccaaactaaagaagctaaaagttagcttcttgtagcgtagaaaagaagacaaaatttgccattttgtaggaagtatattttgcctccttttccagcagctgcttagtgaaagcatagattgtcattggctaaaactcttaaccttgaaaaaggcacaatatcccttgagccaattgtgtacccaggaagtggaaaggaaagcccggtaactcctctctctttttctaaaagagacaaattaagtctgggactcacttgaaaactacatatccctgaggttagtgtcattaagagaggtattaaaatagaagatggtaaaacatttgtttcaatagagaagataaaatatagaagcacatccaaatgtttaggtgatgttaaataatatttctcctagtttgttaaggtttgttggtctgataacatttatgtttttgtatttggggattttgcatctagtgttatgaactggaagcttttggaaactagtttttaaaattaacatcacaggcatttggtggcagtttagacagtggagaacatatggtacaagtcgcaagggattctgtcttctagaagaagaatagcacagagaaatatacgctatgaagaaactattatttcagatgtgcatacacctgagcgaactatggactagacaggtcgtcttgttcacattaccttatcaagagtctagtgtaatacctgacacagcaggtgtgtaagtgcaaatacgggcaggctcttttttccttatccattatttggggcatacccgtgagcctacttttgcaactcttgttggtttatcatgtggtttccagtgtctaaacaaaagacggcaaattacttcattctctgtgcctccatttcttcactttgaaatgagaataacaataggactgattgcataggttgtcctgaggtataaattatgtattagtatctaaagcacttgtaatagtgcctggtacatagtgagcactcaataaatatttgcttttttcactatagttatttgtttattgtctctagcctttcaccaaatacatgctctataaggatagagccttagtctggttcattactgagtgaccagcaactaaaatagtgtcaaacataggctgggtgccatggctcatgcctgtaatcgcagcactttgggaggccgaggcaggcggatcacgaggtcaggagttcaagaccagcctgatcaacatggtgaaaccccgtctctcctaaaaatacaaaaattagctgggtgtggtggcacacacctgtaatcccagccactcgggaggctgaggcagtaggatcacttgaacctgggaggcagagtttgcagtgagacgagattgcaccactgcattccagcctgggtgatagagcaagactccgtcttaaataataataataataataataataataataataataataatgtcgaacaccttatatatatttgttgaatgaatgaatgatcacaaaagtaattatgtacagttaagagttttgttgagaaataaagcttctgctttattggaaaattttgtctgaatattctgtgctaatcatttaaaaatacttctaaatgaatgcttttcctaaatcccagaaagtcaaacaaaattattggtagtcagagttctcttgttcctgactttgttcagcttgaaaaaaagaaattctgctaattatgaatggaggcaaatgctgtgatttgtctatgttccagttattcttgctgcactgcctgacaaccccccgccccctacaacctcaaacttagtagcagagtacaacaagtttgggtgtttcacagtattacaactaggttctgagaggaaagtaacatcctggcaaccagtgttccaagaggttgaggaggaagcctgaagtagcctaggaaagcatatggcatgtcacttctgctgtactctatgtagtcacagtgggcaccagcttgcacagtttcaggggcagggacacagatcatacctctcgaaagagtgtcaaataattggtaatcattttattttagacagccactgtctgatagattgtttccagaaatggcacaataatttctgaccctgtgtcgacagccttgattaatcccctctctcattgattcaaagcttgactgggagatttattttgatcaatggaacaattagcaactacagcacaaccagatacttgaggattgtttatatattggagtttgtcctctcttgctgatcttgggaattcactatcaccatcatgtgaatgagcttgggttagctgctggatgaggagagacacatggaatgaactgctagacatatgagtgaggacatcttagcccagacggctgccagccagtcgccagcagacaaccaacccatgagcaagcccagcagagatgagccaagctggctcaggccagaaatatccagctggcgcccacaatcgtgagctaataaatggtattgttttaagctgctgagttttggggtgatttgttatgcagcaaaaactaactgatacaggggtgtgattgataatatatcctttccctcacccagtttggaagcacttgtaaaataggcacaagaatcaagctggagaggaagtggctttattactgttaaaggcaaggttgaggaaagtggcttttggtttatcacccaagtagatgtgttagtagtcctctggcactttggtagtgaggcagtgattgacaacgctaagcaactgctggcctctccttgtgtgcattgccccatctgtcttacagcactgaggagtagagccagatgtgtgcacagtgtggggaacccagagagctgagccctctgtgcacggccgtttccttctgcaaatctcactgctcagcaaagtattttttctcgtcctggggaggagtgagtaaggggccagcacgctgggggagttactctaaggagatgcttccacatggaaatgtaaagcaaaaggaaatggccaccctcctcacaatggagatggaggatggaacagattactctggattgctttgtttttttcacatttctttttaatttacgacacaattggcttataccttcatgtgctatctcgtggcacattgtttaatctgtgtgtgtgctgcattcatgccattttgtatggaacgtggttttactcttttaaattgtttgagatttacagctttgttcttccttttatatcatatatttgattttattgatggaaagtcatcaataaaaggcatgaaactgcctgttagaacacttcctaaaggaatctctgatcagttttctgggaatatatgtattgaggtgaaatagaagacttcctgtctatgggtcagttctcagtagtgagtggatattcgttaataaagtgtctgtttttaatctgcctttttagggtcacaaatcaaaaactaagagaatacattgcctaatttataatacatacaaggctgggcttcttttttttttttttttttttgagttttgagttttgagttttaaagctcctgaagaagacagaagtagtcaatcattggttgtgaagtatctgtagcaatacaactgaaatttcaaaagagcaatgctgtgacttcgtaatgggtggctttatatgaaagtagatgctttctctttatctcagttttactttgttgttcttcatacaaacatacgtttaccatgaaaaaagactgtatttatcatgaaaggagactatatacaaatattgaagaaaccaggtgctgaaatagatctaaattaacctcagattaatgaattaatttattcattcgttaattggtgtttattagggtagtaaatcaagataggaccagatatttcattaattttatttcaggattgggtctagaattttagattcagatacattcatgaacgaactttcaattatctgccttatgcactggcatatgcttgttgtttaatgtatccttttgctttactgaagaggcataaattcattgaaagaacctaaatgcgactgagatgcttttttcataatattagtcttggagcaactggagaggaggcacagggtctctgcgagcagtcagtttgagtgatagcctttcagtcaagctttcattgtctttctcacctcacaagacaaagctgattttttcgtaattagccttaatcaagaatttggaccacttctttttccaggagaggagagtatacataaaataatgaagcttttatcatactatctaatcctttctctgttacatcctaaagtatgtgatgtgatttttttttcttcccgaccaatacatgtctttttatttatttgtcaaaaaacttcatcctccagtaggtgcagccttagactatttctttcacaccttgtgccttggggaggctgtctctgacatgcacaggcacttatacgtgttgtggactagctgttaatgagtcgagctaggaaagcccctacataacggccaggctccgtgtcgatagtcgggtggcggcagcgcagtggggcggggggcaagttctcattcattgtttctttgtccctgcccccttaacttccccactagagtggcttaatatgtttatctcttaccttaaaatggaaatttatgctaaatttaatataaacttaaatttgtatcttgtgaggaggatgtagctgcattagaatatctggaatatctcttctgtactaaatatccagtgtctaataataactcttctttactaagtcttgttagcagaggctcaattggcggtggtagaagtacctaaggcagaagagaaggccgtgccaatgttctgctttgacttaattcaggggcacatttaagtaaattaaaatggtcaggtggtgaatccctatagtgaattgaatttatgttctctactttgagtaattatttggtatggcttcaagctgttagattatgttggtgcatgcacatttaggggaagaaaaccaataaggaatggtcttaagcatgagtaaatttgggggcaaacattttccctgattacttttctacctggaagcttgtgacttatgagaaaagtcataaagaaattgaaatgggaggctctagggtaatagagtaagcattttaagtggtaaaaccttcaactgctttgtaatgaaagattccttatcttgtgtgattgagttgcttaggcgaattcatgtatttatacaaagtacagcatttccaagtgtttaaggacattgctttttttttggctggaaaattataaagactgtaagcatgatacctagtcacccagagctttgaattctggctctattgcttaccaagactgggatgcgagcctcattttctcatttgtaaaatagggattataaaaccaacctcagggaaggtgttcagggttgaatatgataaaaaatgaaaagcactgaacgcatagcaaaaggtcagggaaggttctctttctattttccctttgcacctttccttttaaactcacctagtatcatgtttcacattggaatatgagagtaatcactgatcatatcagtgtgtgcagtttacgaagtacactttgccagcattccttttcatatcgtgcgcaagtgaatattattcttgaacttggtggttgttatctgctgaatcttacagtcattgccatttctacactctgcaatgtctatgagcgtttattcaaaaggtgccaaacattagactggccagtgtgttgctgttgcacagtgtagtgttgtcacgggctttttgatggtgttattttgtgtcttgacctactacagtttgcttttgtaatgtgattgtggaagtgctgccaaacaatcgcttgtcatcattataaggtgccactgtaaggtgagaggacagcagctcacctcgtcctcactcacaagggccttggcatctcactgtgaagagagctgctgctgtttgtttgggtggcaagagcagccaagaacatgtgtgacttttgtagaccaagtggaaggtcatcacgtgtccagctggtgctaaacttcttcccaaatcgctggcacatagtgcgttagcagtagatgacctgtttgaaggaattcgtgcatgaatggatgaagtcaaatgtagcatttgtttatattttttatgtaatcaagccactttcttctaaacttgaggaatttcctataaaaattagcttttcaatgaagaatctgcccatgccctgtgggttttttcttctaaaactgttacaggatcccatagaagctcagtcacatgataagtaaaatcgtactgcatgtttaacattacttatttagtctatcttgtgctttgcatgtcagtttttacttattaattgactgaaacattccattttttagagatggtaactattacacaatccttttttccctaagttatatcccacttgtacttttcaacctttggggttttttttttttttcatgttttctaaatatgaagccttcattattttccatctatgatttgaggacattggcagtcttccaagtcatatgagagctggagaacatgaaaaatctgcagcatcctgcgcctaataatttttgtacttacatatttttgttctttttcagttggctcaattttatgttttcttatgctgcatctctttattcttacaatcttatgtatttggagcacgctaggacttctcattcatcaaatatatatcctttcactctacctaaactcctccacaaatgctggtgtaggttccagaaatacaaattaaaaagtttaatgatcgttcctagattaaatggcacatcattctctcccttaccaagcattatcgtgatgttttagattgcagcctgattagggggacgtgaaatttgtgtgttctctagaattagtgctcaataatgacattactaatttggaattttatagttgaagtttgcctttgcccacagccttttgtatcactattgagtgataagcagggctccagacaagaatatcctcgtcatccctcccttccttcctcctttcccatttgaaaatttgggaagacctcagatttatgggttgaaaaattatctggagtcaatgaaaatataatatcaaataacaccaaattccattcaatgagaaccatctttctctaagacttcaagatatccacaaactctacgttgcttctcccaggtagtggggcatgtgggtgcaagagtcctaatttcaaatcctagttccacaagctgccaactgagttatgtaaactcctggactatcagtgttttcaactgtagaatgataccttataaaagggttgggaggattcagtgagataccatctgtaaaacactaagcacataataagatctcaaagtattaactaatttttattaaaattactaggtagactcataattgaatggctgtatttcattgcttacatttgtaacgtcacattttcaggaatttaatgtcatcataaaaaaccaagagcatttattagtataaaaatgatatttaatcagtgttttgaatgtaacttatttatatattcattatttaaaaagaacgtgacctgtgtaatttggtgattttcattagagttgtggttcttcctgaagctagaactgaaaatacagcttcctttattatttcattttattactgcagaatagaaagaaaaaagaaagtgagaaggaaaaaaagcatggtggatttggaagtgaaacaaatgccatactatgatttaactcttctctttagatcttttagagaaatctcgggttgttaaacagccaagaggtgaaagaaacttccatgtgttctatcagctgctctctggtgcctctgaagagctcctcagtaagtctctgtttctatgtggtgttgttgttgttgttgttgttgttgttgttgttgttggagctgggagtctcactgtgttgcccaggccggtctctaattcctgagctcaagcgattctcctgccttggcttcccagagtgctaggattacaggcatgagcactgtgcctgaattgtttctatgttttaattttcagtgtcacagcactttttgaagcattctctttaaaacatactccatatgctttgccccttccttcttaagaatattttttatgattctagttgaagtgaagaacatggtgtatttgcttctaccacaccccagggtttgtgtaatattcttgtacctcaccagatactgtgccatacgtctccgatgtgttgaggactgtgcagatgattcagtcaactcaagtggaatttcagcagctagaactgcctcagtctggacttggccaaagctgattattaggggagggactaatcatacatttaaaaaataaaatggaagaatatgatttttctgtttggggagagaaaattatcagggttctaattaaatgagtacaattctataaaaacaaattgctaggtgaatatttaagaatagtggggaagacattttgcagttgatacaagagataaagatctgatatttgggattttagagaattaacataattccacaaagatactatctaatagctaatagctaatgatgaaaagtagtgaacaaatagttcaaagaagaagagctatgaaaagtcaacaccacttaggaaaagtcatcttcactaataatcaacaaatgcagattaaaacagccctgaagtatctactatattattatatatgtagatatataatatatacatatactacatatagtataatatatgtagaagtatctacatatattagcaaaagttattaaggatcaagctagcagagttgtcactgatctgcttggagcttgtggtatacccatctgtgtagagctgcgggtgttacttcaaagcgaggacctcttataatcagagcatgccatccagtcacaccactttttggactatattccaacaaaataattcagatatgaatccaaaaaccaattggtatgaagacatttatcactgctctatatttattattataaactagagaaaacccaaatatccaatggtgagggaatcaccaggcagaacacatatgttataatgaaataatatattgaatcaccaggcagacctcatatgttataatgaaataatacattgaaggtattttttattataaaaactctggaaagagacttacctagataagtataaaacagagtttgtgctatcacagtgattaaagtcattttaagaataatgctgttactgatatttgggtataatttgtgttcttttgattcaatacttaatataaaagccatgttaccgatgtgaacaagatatcaaagggaatgagatattaaagattggatttattgaagcaacttaacaacttgtgtctttgattcaatagataaacttaagcttgagagggatttcagcaggtataactacctgagtctggattcggccaaagtgaatggagtggatgatgcagcaaattttagaaccgtgcgggtaagatgtagtactttcatcaagctttaaattgcataccactgcattgctcagcgggagctggtagcaattctgagttttctttaaagtgtagctcattctccctaaggttttagaattatacaagaattctatttttgttactttgatttttttactagctcaaaaatcacacaagattgtgaaggccatgcttttattagagcatgtgattttaccatttatcataaggagctttcttattctattatcctggggtttgactcctttaaggttatttttaaattccaagtgtttttatggcaaaagttaatttccaactgcccttggatcatgttaaatcaaaactatttttgagacagaaaaaaatctttttatatagtttcagaaactcatatataaacccgagcgattagcattccacattcattagaaaagatgattttaaataacactatactctgttttctgtcttaatgtgtgatacacttgacatgatatggtaactgggatttacttgcaagtgagacagctgtggtgatggggaaaggggagagtaggatgaattatagataaaacaaaattggcatctgttaattgttgagggtgagtgaaaggacatgcgggttctttccctgctctctctacttttgtatatgtttgacaacaataacaaaaacttacattactcccattgctgtgtagcctagtcatttttaaaaagccagctgttctcaaaaagaaagtatctcttacagtatgtcgttttaaaaaactgtataaacatcttcatatggaagcaatagtctgttgatccctggacatgattttgtttaaaccttgagtccaagactggttttagaaccactttgcctggcacgtaattggcactccgtaaaaatttatgaatgaacagatgcctcctgttacccagtatcttgggctgggctcttcacctttgcaaaccacagtttttctgatatgtaaaatgaatgaggagcttttctttgtatggagttgtgcaagttggttttgtttctagtagcaaaacctcagtgtaaaaaaaacgacatacatacaaactgagctgctgtggttgaagtggaagtagggacccaaggctctgctcccagcctcctgtttcttctgtcttcctctttatgtgccctgcaacccccgccacagcaccagaggtacccccagggttcctcgaatcacagttggaaaccactgaagatatagctttgtcttttatgggtttttttccccagaaataaatctgtaatatgattcattaaaaaagaaaagaaaataactataagaaaaaaatagttgcttttttttttctctccccagaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatggtacatccgtggagaatcaactttgtttgtttaggaaacttgctttgaacttctccccactttttaatgtagaaagtaaaatttttgctttgcattggtttgagaaagctttctaatgaaactgagcagaaatagaactgtggctaagctttgttttttgatgtatacattttatactgatctgtttgattatgatttagaaagaacatcctaagccttcaaaattattattagcagcacgtgtacagtcactttttgtgtccatcccctgccttcccacagagttaaaagaaatttgtgaattgaccggcattgatcaatcagttctagaacgagcattcagtttccgaacagttgaggccaaacaggagaaagtttcaactacactgaatgtggctcaggtgggtgaaacataatgtacagacgaaagtttcttaaaagtctgtgctaattttcatataagtataaacaaagattttagtttacaggctgttacctgaatcgtactatgttctaggcattgggaacagagcagtaaactaaacagataaggatccctgccctcatggagcttaaaattctggtagagggaattagatgataatcagtagacataagaaacaagtgctgtagcaaactagcccgtggtgtatgatcagtgaactgagagcaacagtagagcagagtaggggagctccctggggcagggaaggagactcaagtgaggtgggaaatgactgaagggttttgagcagaacagtggcatgactgccttgtatttcaaagggtcactctggctgtgatgtggagagcagagggtcagggaaaaaggagtgaaagcgagggaccttcgaggagatgtgcactaacccagagatgatggtggcttgaaccaggtagtcgcagtggagtcagtgagaagtggtcacattgtggatattattagagggtagaggctacaggacttgctggtgctagctggtttaagaggaagagaacaatcaagggtgatttaatgtttttggcccaagcaactggaaacatggagttgtcatttactgatttggagaagacagtgggagaagccaaattggcctccctgccttacttcttgaaccccctctacccttgatattggggccagtgaagtctttagtctttgtaagacacaaatctgagctgctgccttctctccttttgcttcaagttaagtgggtgggtgtttggatggttgcatgcctgtatacgtgcatgtatacccaggcagcttctgcagcccctttcactaaaaccctttgtgctatggcttacgcattttaccaccagtcaatgactcaggctagaattaaattactaacttaggacttccactcaggcccccactttgtccaactgtattcttgttgtctcatcctcataactatccataaagcctccataaatggtagggtggagccaggcttgccctctgttgctgaaccagcctttcctactataatccaagaatgcctttatgtctttagctttcaacattgatatcttattttaggtgagttattttggctgtggcaaataccataactttatatatatggaaatttggtttgtagcaatcgtttcctagctatagccattgcctgtccttcctcctaaattactgcttttgctgtcatatctgtccaagtcatcctcactaattcacagtcagatacgaagtaacttacttaatcaaggaaatgctgctgagagcctgtacagcacaagcccacacataggccctgagttgggaagtaagaggttagggaagaccccatggaaacaatcaaaggatttagatgtgtgaagtatggctgaaagggcatatcaaaaagaaaacattgagaaaagccagatttggggcacatatcagaagaaggattaatcaagcttggctatagctgtagatatgtaaagaggattcagagcaatatggctggaaaggtgaagtctgcagtcagagtggcaaatctgcaccagtagttcttaaacttgaacgtgcatcaaaatcacctggtggactgactgactaaacatggtttgcagacctcacccccagtgtttgattcagtgggtctggggtaggaccgaggaatttgcatttctaataaattcaaaggtgacactgctgctgctgctgctggtccaggatcacattttgagagccaccgagtttggacattttcaatagccagagtgggaattgttaagtctgtaaggaagccatgaaaaagcctgtgttgtttaagaagaccctttaggaatatgtatattttgggtctttttaaaattgtgtgttttactcttgcttttttaatcatcctgtatgggaaccaggcccaggtgcctctgactttataagcttattttagtcaccttacatcactaaagaaaactttccacattttcttaacctttggcataaaagaatttggctagagatcctcagctattcggctccttagtcaactgtttttttttttatttttaatgtagtactcagagtatctggttctactgatctattgcctgggaggttttgattgctgtgagaagtgatttgttttattagcctttccacatagcttcaattcctgggccccagcatcatctttattgccccatgcctccttttcccaaggcatttagacctttctctagataggaggactaatactgaaataatagaaactcaagacaagagtttttcagcttctccgacatactctctccttggcttctgatgtcctctgaaatctgatcccacacagcttacctcagtttattccttgctagttctctgttacctgctgcctctgctccgacctgcctatcaccccccatgtcatgctcattctttctgcccatctaaatgctctacctgattgtgccctatcctaggagacttctttgatcaaataggcctcctgagacaccccgcacccccatcagaacctgttttttttgcagtttggcacctgtcctctgcttgtttcctctgtgttagtttgatctccttagctccactctaagctcctggagggcaggccccatgtctgtgcatctctgagtctccaccttgctttgtcacttgccgtcctagaccatgcctgttactggccatgtctgcagcacattccacctgggcttttcctctctgagtttcatgcagctgcagaagtgcatggtcttttcatagtgtgctttgaaactgagatggtgaattagtgcactttgagtcttccctcgtttctacaccccatattagtggtccttaagtgggaatagacattccttcccttactgctttataggataatgttgtggagatttggtggcatgaatcaggctcaggaagtcaggggtggcacattggcagccaggtggcaaattggcagctcctagggccaggtaaagctcaatatttttagttgactaaagggtagtattttctttggttttgtttgtttgctctttaagttttgaatttgagtgcctttagcctggaatgcatcctctaaccccaatagagagagccatcatttcctgttcatttctatcacacagtccctggaaacatttgagtttgagacccctggaataaatattgttgaagaaaccaaagaagattaatattggctgtgaatacactttaaaaaatataaagcaatttatcagaataaattgtcactattagttcagttgtttattgaaatagtggcttgttgaaagtagatagcatgtaactaaaaaagctggacgacattaagatgaaaaagggctcatttacaaaaacatggtgttttgaaattatgtggtgttttgagataacttgaatttataagaagaaaaaggaaaggatttggaaattatatagcctcatgaggtagtagtagacgaaaaggatacttcagaaatcaatataagtacatctatagactaactgtgtgctaggcattattctaagcacttaaattacctattttaagaaagcaaaaactagaagaaagggtattggggaaagatgcatctaaattatattttgatttctctgttttagcatttgacatgcattttctactatggaagcattccctcccttgtttgtttatttgtttgttgccaactcttaggtatattctctaaccctaattggagtagggagggaggtttgggattagcatggaaatgtcagatgaagggaaaaggtgttatcttcagctgtgttatgttgccagggaagtgaatctgttattaaagttgttacattttatttaggaagaaatgtagagaaagtattcccacataatctaacaagttgtgctctttgtaaaataaaaatgtactggttaattttaacagtaataccccaatttttacttagaagcagcaaaatacacacatacggccagcatgttgaaaatagcaacaaaacctcaagctttttctctcccaaggccagttccttgttaggctgctgacacccaacctccaggcctccccaggatgctggtattaaacatctcattagtacttacttactgtatgctctgggcactcggtgcatttaagggtgtttagattcttctgtccaaacctgactttcttcggcctttggattctaagagtcatagagatgcatatgtcttctgcctctttgtcaagtagttctgaataactttaaaagtagataagcacgtaagaaggggtttatgttcattctataacttaaaagaactcattgtggaagtttttttaaatactcaagtgattagtgtggccaggcatggtggctcatgcctctctaatcccagcactttgggaggctgaggtgggtggatcacctgaggccaggagtttgagaccagtctggctaacaaggcaaaaccctgtctgtacaaaaaatacaaaaattagccacgcgtggtggcacacacgtgtagtcccagtcactcgggaggctgaggcacgaaaatcccttgaacccaagaggcagaggttgcagtgagctgagattgtgctactgcactccagcctgggcaacagagtgagattctgtctccaaaaaaatttaaaaataaaaaaagattgagtgaagaaaaaaaatttgcagattccatcagtcaaagccattttcatatatctcctttgaatttccatttctgtgtataagggttttaaaaaatagttatcatattaagtagacagttgtttaattttcacattacgcgagcatttccatttcattacctgattttcataaccatcactctctgatgactatgtaacattactctcagtgcatgtttctcttactaccccctattgttggatgtctaaattgcgtctgatttttctctgttccataaaattgaaataaatatctttgtggtgaaagtttttgcagtatttaaaattagtttcctggtttgtgaaaaagtgtaactgtgtataaacaatttgcctaattctcttaaaggtttgattgtttatgatacaagaaaactggttctgcaaagatgtgaaataaaagagcttcaaatattttttaaaagtatctttatgattttattaaaagtaagcattgtggaattgtgggtgttaagttttgtttgtttgttttttaataggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggtaagatttaaaattttttttgtattgtctttagtagagtggaatggttggaaattaaatcctgtattatgtagacattataagtaactgtaactttgaatctacaaataatccttgtgtagatgtaacacactatcactttgaatctgccaacaaatctttgtgtagatgtaacaaaatttggttgtgtattcctgcatgtgtgcctgagtgtgtgtgtgtgtgtgtgtgtgtggtgtgcgtatgctgagagccagcattttggagacagtactgcttaaaaagaactcgtattagtacctgacttttgaaattgcgtatttaaatttctaaccgtgaggcttccaacaagctacaatgagtatgtctgtggccatttgtgtgttgttagaaagtgtggcaggttggtgccataaagaaagccacaggagggctggacataggttctggccttgccagggctggtcatttcatctgtgagactcagagaaagaggatttggattaggtgatgtgttgagtctcattactgtgatcttatgataatgaattctgctgcagaggttgaaataatttctgctgaagctcatggtgaattttttaaaatgattctatgcttgttacagattaaatatttaaaccatttgtgcttggttaagcaacacatatacctaaaattagaatgatatagagaagatgagcatggcccctgaaaaaagtgatttggaaaataaacattatctacttatgttagaatttcctttttgcccccttgctaactttgacatttagaaggagttttaaggatctattaaaacatttattctcacttttaggagtggtattttagtttggttcacggaaataagaagtagatcgggctcctcctttcttaattctcctccacaagtaagatttgtgaatttctttaaggaaccaggctctgcccagaatgttcccaaagaatttacatgttctaaaaaattagggtcacagaatctcagaaaaaaaacatcagatcattcctttcacctaaaccagaccttgctagcacatgcctttttcttagtatgttttccctcaatcatattctatatttaatagctaatggtaagtactaattgagggccgactgtatgtaagcactgtggtaagtggtgtgtgtatggtctgatttacttttcaaaacagcctcatgaagtagctgttattattatgaattccattttacagatgagaaagtaaagctcctcaggtcaactaactccccagggttatacagctacttagcggcagactcaggacctaaactccaggcccttttaatattttcatttattgcttttctttcttactaagattgagaccaggggcacttcctcacctttcttcccaaagtaacaggttccccagtatctggaagtaagaaaaaaataaatgtggtaagtctctgactcccctgtttctccacccttgtcattactccaagctcctggccagcattgggtgcttcgtagatggaagtgtgtgtgctggtggcttccccatggggtccccagaacagaggtcttcaacacagcatctgcttgtattgctgcccatttagcagaatctacaaaggaaagctaccaatttcttggtagaaagggaagaatttgaggtttctgagttaggagaaatgcttgagtacacacagaaatcactgccgaaattaatttctttctagcaagacctcaagttactatcactaaatgggcagaatgccaaagtcattctttacagttggcagggaaaaagacttactacctagcacattgctgtgctaatctagatttaaatggtttcatgagcaggggagatgggtaagcagagatttcactagaaagttagattaagaagatacattcaatgacatttccaaagtcaaagaaactgattttgttttaattttgctagaaaaggattattgatcttaagccagtgggcaatggcttaatatcatatcacaacacatggaaagtttaaaaaataggataatgaggttatgatgggatatctagttaactttgacttccagtaggtcctaagatctaattagccatgggaaaagaaacacttataacactcaaaggaaactgagttataactcataaacaattcgagtcatttctcaagtgtttattgagttaccagataccagtagtaaacataactgagatattccttgtctgcatggagcttagagtcttagccctaagattgagagtctgtggctgccagaggatgtatcctatcaggtaggaaagtctaatcaggaaactatattacgttttaaaagtttgtttgctacagacctaatcagaacagaagtcagatgttcctgtgtaaacatcctttaacttgatgctgggtgaaataccctatacccttcagcaatccaagaatatttttcacttctggttaattcaagtttctctccatacctgtcttgctgaatgtgccctccttctgcaagttataccatcatttttctcaacactgtttcaactagagacttcagtttatgaaaatgcctgcgttatatttccttttttttttttttttttttttttttgtgacggagtctcactgtgtctccaggctggagtgcagtggtgcgatctcggctcactacaacctctgcctccagggttcaagtgattttcctgcagcaccacgcccagctaatttttgtatttttagtagagacagggtttcaccatgttggccaggatggtctcgatcttttgacttcatgatccacccacctcagcctcccaaagtgcagggattacaggcatgagccaccgcgccggcctggctgcctgtgttacatttctaaatattcttcctttcttcagaggattactctatttcagtggttctcaaatggctgtgcattggcatcacctggggagcttttgcaaattcagatgtctaggctgtacccagagcaattatgtcagaatctctggagatggggctgcagcagcaacctttttaaagctctgaggtgattccagtgtgcactcaaggttgagaccaaatgctctgttagacagtagtctctggagtaaactgcagattccaaacatgtggtgttcatgctgcttggccactgtatgaaacacccttgtaaaacattgggcctcacctactgttcatctgggcatggtggctcacacttgttatcccagcactttgggaggccaacgtgcgtggatcacgaggtcaggagatcgagatcatcctggcaaacatggtgaaaccctgtctctactaaaaaatacaaaaattagctgggcgtggtagcttgcgcctgtagtcccagctacttgggaggctgaggcaggaaaatcgcttgaacctgggaggcggtttttactccgtttaaacagaactttcagccaaggccaaatccaatcagttatatgtctatagcaaatcttataatggccatcaaattataaaaatttaactttccttctacatgcagtaaataatttttctttttttccccccagttccttgagagaatcaagatttgttttttcattatatttaattgttacctccattttcctttttaagccttctcagattaatcttcagttttgatttttaataacttttttaaataaatttatttgtggggaggttagattagcgatttggttggggatttttaggtacttttacctgctttttaatacagagttacagacgtgtttttcttcttttaataaattattcacatacattcccagatgccagcctatattttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttatttgttctgttgttcttcaattgactgtaggaattaagagttctgccttttagaataccctgggcatctctttaaaaactggacactaaagggcgagacttttttaaaaaaatgcgtctagttgtcccatggccctgcagttcccatgaaaatgccttttttagctgagctggtggaaacctttcattccctgtggtctgtctctgaacggaagagggaaactgatgcattaaaccatgggttgatgacacatggatttgactgcaaaacatcccagtaccagctggaagtgctgcctggctggccacatgtgatccgatgtcagtttggaaaatagatcagtagaacattgataccaaaaataaggtgaagtgaattaaaatgcatagaggaaaaaaaatctagctgtacatcctggtagaacagaagaccaacttcccaaaggaagaaaattgtaatgcaaatactctgattccacacatttatgtttggacattcttataactgaaaagatggtctgtgatttctgagaaatatttatagcatatccataaaagaactgctattctttttttgaaaaaagatattaagttaaaaagtaagttgaacaatctacattgatttcagctcgttttctacatacttatctgacaggcattaaaactggcagatattttactgggaaaatctgattggtcattagtgttctgtagaccaaagcaggcagtagtagctgattatttcacctttcatacagtggagctagtttaacacaggcaaagtgctaattactttcagttatggactccttatttatcttgccctcataaacctcactgaaagtgacccatatatggtaagagtatgataggctggatgcaatgattatttcaaataaaaaaatctaatacttgggcaagagtcattgtagtctggtaggtacacctcatgatcataggatttgttttctaaattgtttttaaaagaaattctggctatagtcagcaccttctactctagtttcttgccttcatttggtccttcttatgctagaaagcttataattgaagaggaaggaaacaatttaaagtagatttaaaaacaaaagatgacaactgctatgatttgtaaaagatagatagatagatagatagatagatagatagatagatagatggatccaactgtgtgaatagccagcaattcctgaatcccagagccgggcactcctccccatgtgtcagtctcatgaatcaaagtcttatagtgtatattttatggatatgctgtaaatatttctcagaaatcacagaccatcttttcagttataagaatgtccaaacttggcacggtggctcactcctataatcccagcactttgggaggccaaggcgggcagatcacaaggtcaggagttcaagaccagcctgaccaacatggtgaaaccccgtctctactaaaaatacaaaaattatccaggcatagtggcatgctcctgtagtcccagctacttgggaggctgaggcaggagaatcacttgaacccgggagacggaggttgcagtgagccgagattacaccactgcactccagcctgggcaacagagcgagactccgtatcaaaaaaaaaaaaaaaattcaaacttaaatgtgtggaataattggaatatttggattataattttcttcctttgtgaagttgggcttctgttctgtgtaataatatgtgtgtatttcttccaggtataaaaagtttttagatgaaagcctattttaaaatgtttaagaagagcacgataacattgtttttcttaaaatttgctgtattttagtatatacctggaagaaaaaatgttaagggaaattttctaaacctttagctagtcattcaattttgtaaatgtctaaaaaggagactatttcatattaaatggttttctcatatattttgaggattttttaagtttacattctaaaaaaagcaattcttgttttggagcctgtttcttgatgctgtgatatttaaaaatggaccgtggttaagtgcattatatttttctataggaacagcattataatcagaagctgtcaaaggctttaacaccaaataaatctttgcaaggaccaacagcatattttacagcaataatatagcccaacttccctaaaatagtgatatacactcaaaatcctgtaacttttatataaatgcattgactcatttattatgcaggagactttactgtatgtaaaaatgtagaaacccccaagccagcatgttatattcaaaatttgacctcaaatcaaagtgctgaactataagaaacactaatatgtaattaacataagccatggtctttgtgtttggactgctcgctgtttcaaatacattatattcacctacagactccttcccatttctctgtcccaaatacagagggacagagctgccacttctatttactgtcttcctttcaatatttattgtttttaaagagcctaagagtttttaaaatacctgtcttccttaaagagtataaaatatcatcagtctcctttgttgctaaggagaatatacaaaggggccagtatttttgatacatcttaatttatattggagagtttatgattgatacttgtgagtataaagtagttatgaatcgactgggaataagattttctgggctttgtttttttgttgttgtttgtttgttttgatgttgaaaggatggactcaaagtctagaattcttaaaagaagccctagcgtttaaaatttgattatattatatacttctaaacatagtaagtgctccctatcccaatctatagttggtaactatagtgtgaaatagcagagaacagacaccttgctgtttgcctttgttctctaaagcagcctcagcttcatttagggaggttatgtaatagaaagcccagaaggtacttgtttgaagatgtttctaagttttagttttattccttagtcttcagggataaatgtgggtaagacagtagagaaaaattgcatacttggagcatgggtggaaaactggagagaggagatgagtcattcctggggcaagttcctgcccacttcctcttctggagactttgattcatgagcctgacacgtgggagagggcctggctcagggattgctggctattcacacagttcttgacaaaccaaaaaagtctccacatataaagttgctttggggccttcctattcatctggtggtttctagtctcagtttagctattttatgaaggagagggggcccaagttgaaaaccaggtattaatttaatatttgtattaatggaaaaatgtgttagacctatacaagttagagttctgtgaactgctgccaggctattccttaattttctgcagattattgattattccttaaatttttgaaagtttttaatcatatgtgcagtcccattttcctccaaatttgaacaatgccatcaacttcagcttagatcacaagagaggtgtgtgtctttagccttcactttgagcagtaaggatcatctaggtgacccatgacatgttttggagactttggaggtgagtttgcaatagatgctgatttctgtggggaagtaagttaatttctacatcggtgattgtgctattctatttttgttttggtttttttttggcggggagggggcggtgtttttttagcagtagagtaagttcagacagtcaagtttttgttattagggcatctccaggagaatactctctccttattggtttttgaaaaggagccttagcacggtactacacagggatgtgtccctggggtgggaaaggggagttacttttggattatgatggatctcttcactttttggtgatctgccaaccaccactgccctgactgtttgggtggatgtggaccttggatacatgtcatgcatgttttctttttttcttttttctttttctttgagcaacatggctgtttatttcacctgggtacaggcaggctgagtctgaaaagagagtcagcaaagggtggtgggattatcattagttcttataggttttgggataggtggtggagttaagagcaatgttttgggggcagggggcagatctcacaaagaaccttcttaagggtgggggagataacaaagtacattgatcagttaggttggggcagaaataaatcacaatggtggaatgtcatcagttaaggctattttcactttttttgtggatcttcagttgcttcaggccatctggatatatacgtgctggtcactggggatacgatggcttagcttgggctcagaggcttgacattcctgtcttcttatattgataagaaaaataaaatagtggtaaagcgttgggacggcgaaaattttggggggtggtatggagagagaatgagcaatgtttttcagggctgcttcaagcgggattggggcagtgtgggaacctacagtgggagagattcaactgaagaaagattttgggataaggggtgatattgtggggttgttagaaggagcatttgtcatatagaattactggtgatagcctggatggcatgttttctttttcctgataatttataattagaagcattggattttgaagctttaaagcttcaggcaagttatatgatgtatcattatttcagtcaaactgtttttatcctgaagaaccctcccctagcaaaccacagttcagacaccacaggaaggtattgtggtcctgtcttttgaattgactggatatgggtcttgatccaaagttttacactgatcaaaaatacagcctgaatggtaaaagccatcatttgtaaccatgaataactatcaatacatgctcacttttagaagtttattgctaattaagaactgactgcattttgtgtaatttgtccctttttgcaccagaatgcagtaagtatgacctgtttgcagtgctggtctgttgcatgctcttgtgttaatagcttctctagctgtgtgagttttgcagtaagtggttgttgaataaccatgtggatataaaatacagaatccatacaggaatttttaaaggttatgggcaaatttaatttagttgtaacttaatccttaaattgttttgtaattgtgaagctttgcctctggtttctaatctgcttgtgtgtatttcatggtcctgttttagaagtgtactttgagctgttcatagctacacaatgtgtctgaggacactagtgctttcctttccttctcattatttgctgtttgatgatttagcataatagggttgaaatagctccatgggcacagacttgccagataacacatttgttccatgagactgttgtctaaaaaaaaagtcaaagatctgctcttataagttattaatgttttacttttacttataggttttatttatagttgcatcatatagggacatactttagcaaagcaattgagactttctgatatatggaatgcctttatgctgagtataataataataaggcatctatactagaccaacttcagtttctaattgaaattgttagctctgcgaatttgagcacagggttttaaaaaatttgtgtgaaaatgaggactgaggagtgccctttgtatctgactatatttgtcaaaattattgaaaataaatgtttgccttttagtaagactcttcaagacataaaacaaacaaacttttatccttaactaagtttagcattaacaagataagtcactgacaatatattcacatgtgttatttatgagtttgagtttaaaatttcctctgatcactgcatcactggtgattagaaattcctagctgacttccaggaaagaatgtagttagatgctgcagcataagtatcatttttaagttttcctaagtaagaccaaagttgatttttaaagatcaactttcagaagactctgtgactttttcacttctatcatgtatggagggatttgaaggccagtggctctgcctgttcacaaggagcagtgagctttggctgcaccattacatgtgggctctccttcctcattagaccaggactggccaccattgtgggagaagagtccagtttaccagtggtggagtcatactatccctcgctcccactgccaccatctttgggcgataaagaaaaatagaggtgaaaacaagttttagtgtcagatctacttcttcctggacgatgtggttcttgataaatttattcatttggtgctctcaggatgtacagcaatacattaagccctgcagattgttcagaaatgatttaggcataaagcttctgtcaacaaattcataagagattaatatgaaggagaggctgctgagacttctaagagtgatcaagggtatgggccttctacagagagagagattgtttcttgtcagggagatgctttaatctttgggtctccatttggtaggaacttcatttgttcatacagtcagccaatacatattgagaacttgctaggtgtgaggtgctgtgtaaggggtaggaatacagtgaacaagagagcatggtcagccctcacccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagattgtggagctcactgtgtctttgctgatccttcagcaaaggaagtgagattgtttctagcttttctgtttggggtgcttctctgtcaactaaaagtcttcatccttcaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggtaatgttgaaatgctatttttaaaagtgttggtccttttttactcgtaatataaattctaattcagaagatagcctaaacaagaagccatattcaaaaggctacatactgtatgattccatctgtcattctagaagaggcaaagctatagagactgattacctataagaagctatagagtcagggattgccaggagataggagttgtgagagggttgtggctgcaaagagaattttggggactgataatggtggtggttgcttgacattatacatttgccaaaacttagagaactgtataccaaaaaagtcagcatcactgtaagtagatttgaaaatattttgagactttgttcaatatcaaaaagtattgagtattcaaatttatagtaaaaataggtaacagttactgagtccttactacatagcaggtattatattaagtgctatgtatagattatctcatttaatataatcttaaaataaccagaagtagtgtttgcagagtcttttcatcattaatttaaaaatatatatttgcttttcacccttttattttttaaaatagccagtcttttttcaagtgtaaaattagttatttcaaaaaataaaaaggaattgttatgtttatatttttatttccttttttgtttatttgccttaatattttagtaatgatattacctgttttcctttattttcttagtatcattttaagccattaaggacactgaattctcttttatctttctttccatatagatttttctaatgtgattgttatccccagtggcttagtaaaacaacccatttactcaaaagctaaatcataaatatttcatctttattttagagtactcattatgcttcagaaatgttttatacttgtctggcaccttttagtaacataaatattctaaaagcacgattcattcttttcctgtcttctcatcatgaagagaatgcccaaactttgatgggtaacttaaaacagtttatacagattgtttaaaacacttctaagaatatataggaagattgctagcttgctgtaatgaatagaagacaaataaatgtttacatttatggacagaatgttaagtagacacagaaagattacatttggctttatggatttggctttgtagccagtgttagaaccagtggatagattttcatgtctttccttatgttgaaaatactttgtggtagcgctggcctgttttttttaacacttgaaagagttaacttccctacaacacaagattgactctaaaattaatttttttccttatgattacagattcagaacagaagaatctaggctttaaattcttgggatcaagttctaacttatttccttataaacattgtaaacatacacaacgtaatattgacccaagggcctgttgagtaaatatttggcccagggccagtgaagtgcatgggaaattgctgcagatgggagagtggaatggaaggcagtctcagaacaggtcaagggtgtttgcttcaatcagattatgtcagtggtaggcagctgcattgagaaagttttgggaactgcctgtgacatttgcagtacccattctataaagaaaataaattcagagaggaagggaaatatgataagatggtcaaagtctgttttatggatggtagtgtcgtggcttcatcttgtgtcattggattttgttctgttttgtcttttaggatatagaatggactcacattgactacttcaataatgctatcatttgtgacctaatagaaaatgtgagtacttaggtacagttttctaaagaatgttttagtcctataattcacccttataaatgttctcagtgcctcaatgttaagcattagtattttcactgttttttatatatatatatatatatatatatacacacacacatatatatgtgtatatatatatatatacacgtacacacacacacacacacacacacacacacacatatatatatatgttaaggaactgcagagttctagagattttattgtagccctaagagatcatacacagttcttgaacacatacatagacagctggatgttttgatacttagccaggatccccagtggccatatcacaacacccttttatgaccttcagacaccaggccttaaaggtaccagcctttcttgtatggttggagcccaggtctattccatgactcctgggcatgtgagtactgatcagagtaggctctgagcagccatccagttttttgccaaatcaaaatatccatttcattcccaaaactctaatgacctcttaacatactattcaccgggtattatattaagtttaagtgacataaagggacaacctctggagctgaattaagtgggaccccagaagtggcttaagtgcagctgtagcattgattcagatcatacatgcagagggcattgcatgtgtgactgcaggtggccagggacctggaatttttcggatgacccaagtatgtgcatatgcaaaaaggcttaaagtgtgaaaaattattggataatttcgagtaagctttctgagtccaagatttttgtttttagatcatattccgtagtttattgtaaatgaattaaatgtaggaagactgattttgtgtgtggaaaacaggaaactaatttatgcttaggattactaatacctgactttgaataagtaatttgaaacagtgtataagccttattatcctgcagtctttttagcaagaccagtttagtgagatgagtgctgtgtttcaggaatacagtcacatgctctgaatgaatattaaatcattttctactcatcttttacaaagctttttgggaaatatgtaattagccagtattttttttcctcagtattcaagatattcctaaaagttgtttctctgattaaattaaacaatattctaaggcatcactatttttcaataagaaataaactgtgtttcaaaaaatctgaacaatattgaatgggaacactaatattccacataagcaattcagatctctgattttggctctgaaaagtgaatttcctgaaaattttcctggtacattttgtgaaggaggtaatttgctatgggaatcttaattttcagaatttctgattagtatgttttctttgataaatataaccttgcatttaattattctcttttaagaagaggagaaaaagaacagtggtaatacacttaatttaactagattatctcagccaaaaatccccttgctatatgattgaagaagctcatgttcacataggaacctgggtatataaaggaaatgtttccttccagcatcattaaacaataatgtttgttctggggatgttatgaacacacttgattcctgagagtccacgcttccccagggttttgtgtggaatgaataaatgctggtcagaggatgtcgtggccttgttagcagaaggggagaggaacagaggactttgcctgggtggaagtaggtggggttgatggtcagtggagtggattgtttttggaattaagacttatgaccccataggggcagtccatggagtagcagtctttatttagcaaagtagaagcttcctgacttctgattcagtttagggctgactactcttggaataaaaatgaccacagggtctagatatgcaacaaataaattttcacttatgtttaacatccatttagaaattccacatgaatttctaaaatctaaatctatatgaaacagatattcttgaaatcagtttgattgcagtgattgttaaaagcagcatctcaaatcacagcatttttttctaggaaataaactttattttgaacacatgaacaatttggaaacatagaaaacgagtttccttcttaggagtgaatcaaataatggccttagaagactgctttgtgatttgagacatgttatagaggctgtattgtcacattcatttctgcttttagatttctttttgaatctttgaggtccaacttgtctttttgtaagagtataaatttcagtcatcatcaggctaaggtgtctgaggcaactcccaggtactgttgttctgtgcgaggagagaggaaccaagaagacacactcttcccaaccacaccaccatacacacacctgggatccttcaggaaagagctgattcctgtggcttttgttattgttttgagtctctgctttttgttataactgaacagacttttcttgtgactaagttgattgtgtttgatggtgtaattaggaataattattaaaacaatatagtgaggaaggaaggaaacttttttatttccgttttcccagaacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtatgggggagctgtgagcacccagtcaggcctgccaagttacccctgcaaggaggctgtacctcagagatgggcgttcgaaaccccattaacttgtgaggacaaattgagctgctaaagtggttgaatcgataaatgttcaatagaaatagaatctggaccatgttgactaaaatcttattaatacagaaaatcaaaagcaaagctaatggacttaatgaagagtctaaatatatttttgaatcatctttattattttcaaactctaagctatcctataaaaaatatctattaacactattgaaggagatttgccagtacaaattaagagtcaataaagacttaaggctttaaaaacacaagccatttagcaaaaataatgaattatttgagattttgaaatgacattagggaaaatatttacttttttaaaacacttatttatttggttaatatttgggggaattaattttatgtctaatatataaagacaatgctaaaaacaatcttaattgattaatctttagaatcctgaaagaatattgattagagctaatacttcctttttcataaaattgcaaacttcaaagggaaaaaaacttcttgattatacatttgtaaaaagtatatagtacctgaattacctttaatttcaaaatgttagaacttggtactttattttttttattagcgtatattattaaaagataatttctgatcagcttttctgctgctcaggatatttatgaaagtgttagtattgtttctattttgccccatctacttttaaacagactagaattggtatgtgagaactaaaaaataaaagtaaaaccccagaatatgttcagactcctaaaaaatgcaaaatcctttgaaaatgttatgataacatttttggagtttattcttgcaaatcctgaatggtaatagaatttattttgatcttgtctgtgatttagacagatggaatttaaacttggaggcgaactcattatgagagtgtgactaacatgtcagggattttttgatggtgaaggaagtggctgcaatgtagatagtcttggagtatttttaatagttgtttgacattatagcatgcaatgtgcctgtcattgagttacatgtgctgcttataggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaaactcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaatttttttcaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcaggaacctataatcccaactacttgggaggctgaggcaggagaatcgcttggaggcagaggttgcagtgagccgaggtcacgccactgcactccagcccgggtgacaatacaagactccatctcaaaaaaaaaaaaaaaaggaaaaagccttctgggctcttctctttttctgcttctagggcatcttagacagaactctctctagatttagtaaagaccaactaggattagagtttgctatgtgtgtatttggtgagctagatagtagaaggtatgtgtctggtgggtcagatttcatagagcacacccatacccacaagtaccttctatagttgtctttgaaaatgcagttatgaggaaactagagtgaagaatatttttgtgtttagtttgtgtgcctgatatttatatttacagaaatgtaagtagacaaaaccctctggtttgattgcagtcagattagaacatatgttggagaggatcctagtttaaaaaaaaacccaagaaactttctgtgatgagttgcttttgttattctcaattgaatgaattttttttttgcatcttaactctattttattgaggtatcatttatgtgaagtgatatgcacagatctgaagtgaacagttcaatttttttttaaccattatatatgctttagtaaccaccacccaggttaagacgtaaaacatttccattaccccagaaagcttcttcattcccctcctttttttatttttacagcttttctaagaaatcttaattaataaaccccaaggttgtgaatatattatcgtatattttcttctagaagctttatagtttcagatttcatatttaggtctgtttcccccccatgtagatatcctgttgcactaataccatattgaaaacagtcttcttttcccattgatttgctttgtggcctttattgataatctgttgaatgtatatgtagggatctgaacttactaggccattccatttatctatttgtccatctttatttaagccaaagagtagacattatttttataaatggtaaaagagaaagcatagtaacactgatgccaaactagctaagatgtagttgtccacgtaagtgtgtaatttcacagttgtagttaggcagccataatcatgaatgtttaagtattagttaggacacagggattgctgcagtatgatccaaagctagcaatgatttaagcaagattgatgtttatttcttaagtaacttctaagtatgaggactccagagctgacagggcagctccttctgttttgtggctctgccgtttcctgggcgtgttcctcgtctgcatggaggaagatggctgtccaccgtgtcaacatttgcagccagcagtaagctggaggagacgaaggggagtgcctgtcccttcttctaagaacactgactagaggctgcagacattacttcccctctgatcctagtggccagaagttgctcacctggccacatctacttgcaaaggaggttgggaaataaagtttttccctgggcagcaaagtgccctgttaagaaaggagaacagatatagggaggaaacagtgttttttatctttttattgaggtataatacacatacattaaagtgcatggatcttaactgtacagcttcttgaagttttacagatgtatgtacttgtgttaccccatccagaccaagtggtaaaacattcccgtcagtccagaagattcccttgtgtcccttgcatgttgatcccccactactacctctccccagaggtaacagcaatactgatttttaaccatgggttagttttgcttgaacttgatataaatggaatcataactacagcatgtactcttgtgttgggcttcttttcactcaatgaaatgtcagtgatacttatccacattattgcatttattagtgtgttctttttaaaattactgtgcctgcagtattgtatttatttttaggtggttataaaatgatttgaaataatttcaaaagtaatgactaggtttcttaagaataacataattgttttgctatgaaacagttatatataatactttgtgaaaacatagacaattatatccataggaggcagtttataacctaaaatctttgtgatctttaaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtaagaaattcagtgaccatatttaataatgaatgttttaagtggtcaaataatacggtgttttttcacatgctgttagataaaacagaattttatgaaaaactggatgtaacctctgttttggaccttcttccattaggataccattttgtgctaaggtcaaaataagacttaccaaatccacatttgggacttgtatggcaataatattaatttttagaatatgcccaaggtaggttcgtaggaggtggtttgtaatttgatacacttatatttgtgtagaatcatagaagggtagaattagagacaggttggattaccacttgtcacttttcccatgaagaatttggctgcagagagaatcagtggatgggtgaaggtccctctctttgcctatatctataccagttaatcaatagacgatacgagcaggtaggattcacagtgtcagcattactgctaggagagctggattagagaacgtagcttggacccagggccatacagctttcagctggtctgtcctgaattgcatttactcatccagtcccagacagagtgctggacaccgcaggcccagtggtgcatccccatgtcctgtgagctctccacaggcagagagaactgtgtactgacgggcggctgttgcaggagagaaatcaagccttattccttctgccctcaccagagaggctgctcctctgcaggctgaagaaggcttgcccctgaatactgctggagggctgacatgcctgtttcatgggcctaggcaggaaatgggcgattttcatttaactgtactggtattgcctacacattattctcactgcacctggcctttcacaggaacatcaacacacctaggacacttaccttgtattataagaagatctagaaactccagatgtatggtgcggtctctgatgcctaatttagtaccctaatttaatgtaggatttgggtactgtttcagttcccattgctaatttccggggtattatggtaaacaggtaccataatacagaatgtgtattcactccctgcctggcatctagtctgcaggtgggtggagtgaggtttagttctaaagactgatgttgaaaccggggtccaggatggagaggtcagggccaagtccagttcttgctcccgctgggtaaggcccacgttccttagcgtcccgttggtctgggactgtttcttggtctctgcttttattctcaggggcagaaacaatgtttaaaatattttcaggaattaactgagtgagtttaaaatagatctgaatttcttgcacaccctcctggcccaggttggtacatcattataggtatttttgatacaagtattgcctctactaatgaaatcaagaaattggctttaataccacattttcttagaatacatagttatgaacccaaatttactttttcagtgtttactggattaagtttaatttgtggaaaattctttgataaatggatgattgctgaaagagcaattacacttggaaatgaagctatgttttataccactgagaacctgataccatgatagaagataaaactatttttgtaactcagaaaactcactgtttttatttttatttttttaggtctggtgtggaggtcctatttaatgaattagaaattcccgtggaagaatactcctttggtagatcaaagatattcatccgaaacccaagaacagtatgtaacgaaaacctttacactctgaacttaagttggaatcgtataggaaagttcttaaaatatgtttaactttataacattatatgaggggccaccatgaatgccacaaaacacttgtgtgtttatctacaaataatcaagaggcagggacagataagggtaaggggcggtagaagaatgcgtattttttatgaaccatcaaagtctttgctctgacagattgtacaacacttaagaaatcacaaagaaactgttaggacaacggtgcaacattcatagcaactgcaggtaaacagtctgtatttgtaatacctgaattatacattaattttaagaactacagccccattatttagaggtacaggaaagcactaaaatgaaaattttttttaagttaaaaaaaatacttttagcattctacctcatagaaccccaaggaaatttttttgtcaatgaatagatgagtgtgaagtgtaatgagtatagcaggtgactggtaatttggaaacgttaagattttggaaagtatttaattcatttaagagaattttccagcatctaccttccattagtaatttgcatcctcatagacagtgtgaaggtaaacttaaggtcaattcagcccctctctgatttgtcataaattctgaatcactggaataaaaattgtaagtctttcatgaatccatcaaaataattttctcatggaccattatccatatcatatataatgcatatggtttttcagttctttttttcaatgtaattgactccaacatgatggcattttgtctcctgaaaattcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcggtaagagtctcagtcattttaaatcagtaataacaatgctaatttgccaacatttattatgtacttaccatgtatgtgatttttacatacttaattctcccaacaacctcatgagataatggatgttcttaatggttcttttttttaaagatgagaaaactaagacacaaagctgttaagtaatttgcccacagccacatagctataagtggtagagctgggatttgaatccaagacagtattagagctcaagttcagtgtgccataccgcctttcactgatctagctgtatttggttggaaatacatttttaatttggtcatcagattggaagagacaatatcctttaagcttttgatttggttgggctagtttttcaaagtaattggctattctttggctattctttattgtagcagctttgaaagtggctttaattccagaaagctaatgccatgtttttgtagatttctggttttggttaaaggattgcattctctttagtccttaggtatctggctctattaactatagggaaagattcaataataaataatgtttacctagttaatatgaaatttctttttggcatttccttcctcatttgattgtagagattttgttgaaggcataccacaggtatgagagaagcctgaaggtttgcctcagggttaattgaaacttgggctgtgttctcacaaaatgaattaagtttgcactcacatctcctttcttatattcttcctctttttcagccataaagagactttgctatagggctgtatataatcaagacataatttacgctgacctattctcacataatacattttagtttattatttccaagttttacaaattaatgaggtatttaattgattaagctaaagaaaatcagcttgagagtatctttacaatggctcatgctagttaagattataaccagcagtataagtcttaaaatatgagtctgcccagccatgtgaatgatagagtcattcatatgcattctgcagaggcactttggactgttgtcacccagcctggtggccgtggagtctcctctgtacacatagtaccactccttaactctgctgcagattcataatgctccgttttctgttagcctgagaaagggaggaccaacaagaggaccaaaaagtcctcaaggagccctttttataatttcttattttgaggtcattaagaaaagtttacaagtgtgctggattcatctgtcttgaattctacaaatatttttgaaacacattagcaaggtggacaaaacaacctaattcctgacttcctaaagtttatatctagtgaaagacaatacgcatttaagcaaacaaataatcagaaaaattatagactgttgtaagtgctaggaaggaaatagagaactgccataaagaataatggggaggcgggatgtgacctaagctagagtggtcaaggagaaacttcggggaggggccatttgatcggaaggatgagaaagaacaggcaatgcaaaggaagctcaagtactatttgtaccttttctcccaatataaagcttttatatcatcagattttaaaaagtcacgatttatcattagttcatgatgtcaggagttatgagcaatattagttggtagaatgaaaactaataatagccccagttttagagaatgcattaactttgttctaatgttacatctctttcaaaatttgaactacatacctcaaccagttcactacatgttactcaagccagtggttaaactcattattttccctcaaccagataactcaaaagatttcttgaatgctcctttttagttgctgattacttttaagttattccgtattttgtaatatttcatgtttcctagagatgaattttcaagtgagatatacttattttcaagacatttattaattaaaaaggaaaacacagaggtaccaaatgcgtgtcagaatgatggtcagatactgtagctgttctacagctacatctgtggaatattactctggggagaatcctagagattttccacctcttcatttaacagctggggaaactgaggcccagagaaggtgagtggcttgtctgaggtcccagggtcctcttggattttctccctggcatccttttttgttcctctgcccatctattgataccatcacccattacctctgatcttccaagacatagcctggtagcctgggaaggcatctctcccgcctcagagaaggggggctgagccagctggcacttctaacatgagggattcacaatgtgactttagtacttcgaaatgctgtgaattttcattagggatgcccccatgtttcagtgtatattccaaagtgaatactgtaaaagctcacttttctagggagtattccagcagcctccactccagggcgtcagccctagaagtaagaaaggcctctgggcattgagcttgttgagccagagctgggagcctcactaggtcttctttgaccttccccacctggaagtaacctctgctgcctctgagcctgactgttgtgctttctgtgctgcatctctcccagggtactgtttatcctttatactgttgacctgtgttcacttcaactccttgagggcagggatgcagtcagatgcacatttatatcctcatggtcctattaaaaggctttatgcatagtagaggctcaatatataaatatttaattgattgatagcagtttacttaaatttttagctgattttccagcttgaggcagagtaaaagtagcaaacctaaaagaaactagggaggtttagaggtgggtccagtaagtagcatggtgagaaatgacaccaagaagagagaacactcaaaagcagatgcagaactcagtgggttttcattcaatatgcatttactgagtatctgccttgtgtggaaccctgtattataacagcatgagatgaagaaaataatgataataatgctgtgtcctgagtcatttaggaattattttatttagcatccttaaagcatactttggattaactgtaataatattggattgtttgatattttggtttctttatgtattggtttccagaaggagtatggataattgagtcagttagacgaagtgagcaaataccctttctcaatccttgtatgcgttacagatattaactacaactgccaatatcttccccttttatcctacagcaacaaaagaggtaccagcagacaaagagttccgccttagtaattcagtcttatatccggggttggaaggtgagtttaaaagaagtatgctttatttattttgggttttctggtttttcacaaaggataatgtctttagggtcaccctgcagaggaggggctcctctgtctcctgcctcgcctgtaaacagtcagatggaaagaataaatattatgggccaaacggggaccctggtgaccatgtcttggccacttccttctaaccagctttctttttaagcgctttgttctctaagcaggaagtccttgaaataatacccgtacatgatttcagtatccctttgccccgtgttttcgagaaaagctgtggtacagaaggctatctcacagccattgctttcatactcagaatccctaccccagtgacttccgtaactgtccagtaaccatcttgcaggctacccatcacgattgaaagatcctgagatctggccaggtctagtggtggggacatggaggagccgtcacagtggacagcctggttctaggtccttgctgccaaggcttggttcaagggtcactgaactacaggccacaggctacagctagcctgcttgcgtgttctcatacaacctgcaagctaagaatggtttttatatttttaaccgttgtttttaaaaaagcaaaagaagatgatttctttttttttttttttttttttttttttttgtaggtgggatgtattttttttattttttattttattttatttatttttttttaattgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgacttcaagcatctgtttaacaaagcacatcttgcaccgcccttaatccatttaaccctgagtggacacagcacacgtttcagagagcacagggttagggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcgtctggccgggcggggggctgaccaccccaccaccctcccagacggggcggctggccaggcagaggggctcctcacttcccagtaggggcggccgggcagaggcgcccctcacctcccggacagggcggctggccgggcgggccgacccccccacctccctcccggacggggcggctggccgggcagaggggtcctcacttcccagtaggggcggccgggcagaggcgcccctcacctcccggacggggcggccggctggagacggctaacccccccatctccctcacggacggggcggatggccgggcagaggggctcctcacttcccagtaggggcggccgggcagaggcgcccctcacctccggacggggcggctggccaggcggggggctgatccccccaccatcctcccggatggggcggctggccgggcagggggctgaccccccctcccccctcccggacggggcggctggccgggcggggggctgaccccccacctccctcctgggctgggcggctggccgggcaggggggctcctcacttcccagtaggggcggctgggcagaggagcccctcacctcccggacggggcggctggccgggcggggggctgacccccccccacctccctcccggacggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggcgctccccactcagatgatgggcgggtcaggcagagatgctcctcacttcctagatgggatggcggcggggaagaggcgctcctcgcttcctagatgggatggcggccgggcagagacgctcctcactttccagactgggcagccaggcagaggggctcctcacctcccagacgatgggcggccaggcagagacgctcctcacttcccagacggggtggcggccgggcagaggctgtaatctcggctctttgggaggccaaggcaggcggctgggaggtgtaggttgtagtgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaacgaaaaccagtcaggcgtggcggcacgcacctgcaatcgcaggcactcggcaggctgaggcaggagaatcaggcagggaggttgcagtgagctgagatggcagcagtaccatccagctttggctcggcatcagagggagaccgtggaaggagaccgtggggagagggagagggagagggagagggagagggagagggagagggaggaagatgatttcatgacatatgaaaagtatatggaatagagatttcagtgtacataaataaagttttattggaacacagccacattcatttatttcacagattgtctggctgctgtagcactacagtggtagagtcaagtagtagcgatagactgtgtgaccttcagagccaaaagcagttaccatctggcattttacagaaaaagtttactgatccctgatctaggtcaacgatacttcagagcctgttctgaccactttcctgtgaggagactttgtggtatggtctggatccagaggggtagtgcccaggcctggagccctttcagagggtagacgctgggtcccgagtccagcaacactgactgaccttgcccaggccctcgacaacttaagggcttagcagttgtctcacagcaaatggcaaaacacaaatctgaacatgtagagtaagtgaaactgctgcctgcaggctcttccttggcctcatggctggaccttggggccccgtttataggcgagagaccttagaggaaggacccaaagtccaccttgaaaccaggtgtcctcctggcccccataaaatcagtttccagcaactaatggaaagaagtcactggtttgggatcaatgagatcattttggttttggagttttaaaaatatcttgaataaaaaggacagctacagttacattccaggcaataataatgaaagagatacagtggcctttagaggatcattggaatcctctggcccctttctgagaactgtttcatcccacagatgtgtgccagcttgtggtgctgtagtcagatttttcccattgtgtatcagggtacgggaggctgctgttccaatcaagtggaaacccatgcttaatgatgtcttcattgtccaccttctcatagtcagtttggggctagtcaccttcgccttctttaacctgttgatttatcacaatagcatgggtgttaggacgatcatctcttcaggtttttttttcaagtcactgtcaattcctttatttttaaacattctctcttttgggtgattctgccctttaggctcgaaaaattctgcgggaactgaagcatcaaaagcgctgtaaggaagcagtcacgaccattgctgcatattggcatgggacccaggtaggcccgagaccccaaggaaggcggtgggtcagcagtaacgtcatgtggaaccatgaaccctcggcttcaggggcagaaaatgtttcactggcttgagctactgagcacgtgtttgcttcttgctctttccaacattttgttgtggggtggtggcacatgcttttgcgtttaccatttggtggtgactagtgtctctctttttctttcttcattgaaaaccagcagtaacctttcctgccttaaacttttctgtaactccttttcaaatgcatcacaggcacgaagggaactgagacggctgaaggaggaggctaggaataaacatgctattgcagttatttgggcttactggcttggatctaaggtacttgatgcacatatcccaacactccatcctggaattctgcaataatcagtccttacctctagcctattaggggatgaatgactacaattaatagtggctcacactggtgcatgtcctagccgccagatttaacacacctggaaacattagttcagtagtatgcataggaagcttaggcatgcataggtcaataaaactaattgcttactaaaaaggcactagtatcattgctctttaaaacaaaacaaaacaaaacaactcttaaataacatgcatgtttaggttcccccccgcccccattgatgaatgctagcagttttttagaggttttctggaggggttgcgcatgttgggaatgttcaagtttgggcttcagtcggtcttctgcaacatgttgacaatggaaatgcctctaacatatgtcttaaaaatattaatttatgaatgaaatttttttttaggctcagtgtggcagctattgattattataagcaaaatattacatgtgcaaagaattatcatctgtgatttaacagaaaactatgttcatgcacagctagctatgattgccactgaagaatcccaggaatttcagcatcagctgtttgttttcagaaacaaaggcctcctgaaatactctcactaatccccaggcatagtcgtgggctctgtgaacatttcacataccccaagggacaagatttttagatgtttttgttacttagaaaatcaaagtcatctttgctaaaaatgtgtattccagttagaaacacaaacatcaacagagtcctgtgttttgaagtccaccttgtcaatgttgtaagcctatcttatgagaaaatgagaaaagtcaacatctgcctgcataaagagctaatttgccaaaaactaaccagagttgttcatctgtgcttttcctgaaaatctgtgaagaacaaacttgttcctctagtcaactgagggaaatgtcatagcagaagcaaaaggactcttaggtgggtcttgctaagatttctccatccagtgagttcatttcccagtctcagtactataatatcttgaacaatcagtgcctatttgtatcctttagaatagcttgcctaagattattttttccctaagagtaatttttaaacctataagtttaacctataattgcttcagtcttcctgtatattttacttttgcgaccttagctaaaattgaatttttacacgtgccagttttcattttttgactggaaggaatttttgagttttgttagttttggtttttgtttgcacttcagagaaataaacttttttcctcccagttttctaagtgattgttcacaagagttgtctttttatccatccaaagggatgaactcaggagtgcatagcttcttcagcccaatgtgctgtcagcaaaggggagtctaatgacatcattagggctgttactcagagtttgaaggctttgatatgggagtgaaagagtgtggagaaggcagcgaacagagagagagaacaggagaaaaaaggaaaggaatggaagtgaggggtgggaaatgattaccttgggaaccacacagattgtccttctctggaacagaatctcagtgcactgaaaatataagcgctgcaccagcctgacaccaattctttgggtttaaattgttatgcactgttcctctgtcattctgaaatccttattcataaattggctcttctgtttggtgggatatctttttctggtcatttgtgctgtctgcattgggctgtctcttttatttactatctaaaacattctaggctcgaagggaattgaaacgcttgaaggaggaggctaggcgtaagcatgcagttgctgtcatttgggcttactggcttggactgaaggtacttcctcaaccacttgtttctgtccagggtgaacttcataaagcctagcacctactaaccctgagaaaatgattgattatgcttgctgatggtctgcacagtcttgtagaatgtcatcttgcttaattttgtacctttttcagaagaaacctatacactaatttttttctgattttgtgatttctatttctttaaataataggtttaatgtaatagcaatatggcatgttttattcaagatactatgttatcaaagttctagtttgttatctttatgagtgtaaagttgtttttttaaaatctgtgagacacagttacaatagttgagctaaaagctgccctacatccacagtgaccagcctagggatgccaggcttttgtttccctttttgtaccaattctgctccaataatggctgcctgcagtagagctttcttcagagcgaccattgttctaattgttcagcgttggaaccaaagggtcttgcatcattaagcttacagattttgatgaatgagttcagagattcagagatcagtggatcattcatgttaaagagaacctcgaattcaaataccttgtgattatggcagggtttattttgaagtggtgcttactacagtagggtacacttatgtgtacagaactacacataagtaaataactctgagctctgagaagcccttagaatattctttacaccatgtaaggatctgatcttccaaattcaataattagtcaccataggaagccatccatattgcctttttgggataattaggcccctttctgacagtattccttatcattgtttttactttaatcctatgacatttaatcttactccaaatatttgaattattatctgagtaatcattgactctaagtctgaacaaccattagaaatatccctgaatcctgctttgaacaatctgcattttttttctgcaatttcagcctataaactttagtaaattatcctttttgattatactgaatattcaccaagtaatatttgaagtaattaagaagtaacttaaatatgaattttaacagatgttctatttgaagaactccaaacaagctctataaccggtttttttaagtcaaacaaaagtaaacattttcccatttaactcacatctttagttttctgggtttaactgcatatgatttcaaaacatttttgcattaggggtgtacactagcaacctacaaagcaaattcagtttgtaggggaatattattttagcagaagttaactgggcttactctagacataacttttttcctctcagtctccaacaaaacagaggtactttactatataaccagtattattgtatgaaataagatcaaacttacttgaagtccaagaatataataattttgtactttttttttctaaaagagaatcatgttaatatgaatgataattttgccctctcaaatgattgacttttcctgtggaaataattacaaagtgcagtgggcctttttaagactcccagttccccagggggcaccatcgtatatgccagcatgttgtcaccaggcttttagtgtctgtagtggtattttgggagaaataacctgccctgtcgaatatcaaaatgcatatagcaatgagctcagttatgaggctcaactaaatatcgtatgacttcaggtatatttttaatgatatattcttatgtaacttcatttgtctgctttcctatactattataatttcaggagccaattattaggtaacatttttcttctccttgtcccttctcaccttagtttgagattagaaatgtttgtggatctgacagctctgtggctaaaagacagatgataatcagtaactagaatatgaatacaggcatacctcagagatattgcaggctcagttccagatctctgcaataaagtgaatatcacaataaagtgaatcacacaaatgttttgtttgccagtgcaaataaaagttatgtttacactgtctctactgtagtctattaagtatctaatagccttatgtctaaaaagccaaagtacatactttacaaatacttcattgctaaaaaatgctaaccatcatctgagccttcagcaagttgtaatctttttgctggtggagagtcttggcttatcttgatgtcgatggctgctgactgatgagggtggtggctgctgaaggttgtggtggctgtggcaatttcttaaaataagataacaatgaaatttgccacatagattgacttcctttcctgaaagatttctgtatagcatatgttggcatttgatagcattttacccagtgtagaacttctttcaaaattgaaatgaatcctctcaaaccttgccactggttttgtcaactaagcttatggaatattccaaatcctttgttgtcatttcagcagtgttcacagcatcttcatcaggagtagattccatctcaggaaactactttatttggtcatccataagaagcaactccttgttcatttccatcttatcttgagattgcagcaattcagtcccatcttcaggtttcacttctaattctagttgttactatatctgccacatctgcagttacttcctccactaaagttgtgagccccctccaagtcatccatgagagttggaatcaacttcttccaaacttctattaatgtggctgttttgacctcctcccatgaatctggaatattcttaatggcatccagactgatgactcttttctggaaagtttttaatttactttgcccagatccaccagaggaatcactgtctatggcaggtatagccttataaaatgtatttcttaaatcataagactgggaattactccttgatccatgagctgcagaatggatgttgtgttagcaggcatgaaaacattaatctcctcgtatatctccatcagagctcttgggtgaccaggtgccttgtcagtgtgcatgaatattttgaaagttctctcttttctgagcagtaggtctcaatatggggcttaagatagtcagtaaaccatgctgtaagcagatgtgctgtcatccaggctttgttgttccatttatggagcacacaggcggagtagatttagcataattcctaagctgtaggatttttataatggtaaatgagcattagctccaacttaaagttagcagctgtattattctttaacaagagaatcaacctgtcctttgaagccagacattagcttttcctctctagctatgaaagtctagatggcatcttcttccaatagcaggctgttttgtctacattggaaatctgttgtcgagtgtagccacattcatgagtgatctagttagatcttctggataactttctgcagcttctctatcagcacttgctgcttctttccttaaccttcatgaaaagttaataaacttttcttctgcagcttcctcacctctctcagccttcttggaactgaagagagttaggacattgctctggattaggcattgcttagaggatattgtggctggtttgatcttatatctagaccactaaaattttctccttatcagcaatgaagctgtttcacttccttatcatttgtatgttcactggaataacacttttaatttccttcaagaatgtttcctttgcatttataacttggctgtttggcacaagggtcctagcttttggcctgcctcagctgttgacatgccttcctcactaagcttaatcatttctagctttcaatttaaagtaagaagtgtgtgacccttcctttcagttgaacactgagaagccattgtaggattattaattcaatattaattaatttctatattgctctgtcttagggaataagggaggcccgaggagagggagagagatgggagaatggccaatgggtggagcagtcagaatacacacactgtctcttgattaagttcaccatcttacagatagaaaaataatgaaaaagtttgaaatattgtgagaattatcaaaatgtgacagacacagaatgagcacatgctgttggaaaaatggtgccaataggcttgtttgatgcagggttgccacaaaccttcaatttgtaaaaactcaatgtctgcaaagtgcattaaaatgaggtatgcctgtaaaaagaaaaactgcctataaggtatatgttacagtttttaaaccttaacagtctttagaggtagagaatgggtctggtgcaaaaatgctcagagggaccaggttggtcgtacagatgaggaaagcatcagatgggaggtggatcagaagcaaagggactcgtgtagtttggagcgtgcatgcctcatctaaaggcaacagcagctactttggtctccctggcacttattttataggactaggcctcagtgttgctagatcttagacaactttaagagaaatctgcagtctgaattgttatattgagttcttaacttaaaaatatgcatacagaacatttatctgtaaactgaatttggatagaagattactagcttacatcccgtaatgtagaaatattttgaacatgtgcagttaaacctagaaaactagaaagaaaagaaaaaagatatgtaatatctgaattattcagataggctaatattttgctaaattctaactctcccatttgtatctggatggtaataaatacttaagatatttttccttcaatttcaaaatttaactatataatttattcatttgttatacaaacactccactttgttactgttatttgttagacattagtatatgaagtaaatataacaatgtagcaaggaaaaaatgtgtgaactaaaactataatatgatgttttaagtgctctgatagcattaagtataaagtttggtgggagtagagatgatagagaagaattaatgcaatgaaatggaagataatggtagtttcaaagcttctatttaaattcttagccatattcagttctcagtgtgtaggccttatcttctatgcaaggcttttggaaactgatacagttcttcagactttttttttctttttgccttttacaaaacaatctgaagagaacattattttatataatttttaatgtattttaattggggatgagtttgcagctgtgcctgtaaaatgtttcttgtcaaatcatcagattcttcaaaaactactaagaggatttaaaacatcaattcatgctggtttcatcattttacatttcttaatttctttctctctgacttaagatccactatatgaatgtgtttcaattattttactaaatctagaaaggacacttataaactgacttgtttgacattttttcatttttaatagaggtgtatcattatggacctgtaccagccacacattaaccactgtaacctacatcttctttttaaaggtacgtagagaatacaggaaattcttcagagccaatgctggaaagaaaatctatgagtttacgcttcagagaattgtaagttgacactttatatctgtggataatcagcattgtggaattacccacctaatatcaccaactccataaaatgtgccttttcctaaatgacaaaagtgactttttaaataataattaaatcatagctgtgacactgagagttagttatcttttaaaatcatcttcttccaaattctggtagaattgtgtcagaaagagttgttaatggcccgtatattattaatacagtgtttgccttatttgacaagagagaacttttgggggaaagtggatccaagaaagccatgactttaccctgtgaaactgccatgagctgtggcagggcaaggctggcaagcaaattagtggggagaggggtgacagggagccaggctgtgcagctccacccacatggactctggagttctccatctttcagagaggtgtatgtagtgctgaacagactgcaaactctggagccagcccccactgccacttagtgtgactaaggaactggattttaaaatttaatttaattttagttacttaaaatgtaaatataaatagcctgtgtgactagtggctgcattttagacaatacagctctatagagctagctggtattagcattagtgttaatatgagtgttagcattactattcttcttttctcttaaccatttggtagaactcatatttccccaaccagtatgaaagagtggagtagagacttcccagatgagttacagttctataaattccaaagttaaataaattctactattgtctcgtttatttgatcatgatgtatgtaaaacagtgtcttttgtggtatattttcctcatgtagtattttctgtcaacccaacacaggtgcaaaaatacttcttggaaatgaaaaataagatgccttccttatctccaatagacaagaattggccctcaagaccttacttattcttggattctactcacaaggagctaaaaaggattttccacttgtggagggtaaaaaatgtcatattacatcttttcggagactttcttatttattttgagtgtttaaaaacacataaaatcaaaactgttaacacattcttcctttgcctcaaagaggattacttgaggactttggtgattttcccccatgcaccatattgagtttctacgagagcccctgcagcggcccaggcgttccctgtgcggtcgcctctcggccctggctggaacggggagcacagggctgcattttctttccattccaggttccagctgctctcaagtagttcagttttttgttcatttgtttctctctttgtctaaaggaatactgtaggacagagaaatcataaaatttggacaccttcaggcaacatagttaaatcctgcaaattgaagagtttactttatcagatgtacagaacagataatcagataatacatgtgaacacacacactttgatgggtgggaaaaaaggctttttcctgtccctaaagatagtaacacattctctatctaaattacagggaagctggaaatctgttttatactgccttttattttagctctcttattttgtataagaggacatggcatgtaatttagatgttgcccagcatggaacacgtggggcacttgtatagatgttgaccttacttcgataacctagtcagttgatatgtggaatgttaaatatatgcagttatcagatgtaataaaatcatgagatggaagggcatgtatttagtaaatgaatgctcagtacacacatcctccaggaaactttcctgcccagcacggtgggcttgtttttttgttagaatcatctatgtatagagtgacattattgctgattagcttgataagtggtaccatacaacataaggaactagattctgagttctgttctctaacagcaaatttggcgaggttcatgaacctcttaatggcttgtctcctttcttgagtctaacccagaaactgttttcagaaataatgacagggagctcccattgctggggatctgcaccacctctgccctcccctggctttgcaatctcacccatccctccattggattggaggtgggagatgagggctgtttattcctgaagggagcctttccatggaaagggtcagcagcaatgctcacacttcttcatgcaattatttcagtagcacttgaccacacctgtaactgaatttctaggaatgctcatctaaaaaacctggccctgctcctctggccactgtctcctctcattgcagcttcagggatggagtgaaaggggatatctcaggtccctcatccctattgtaaaatggtagtggggggatttggagcagtggttttcaaactgtcatagcatatttgtggtcatgaaatcaatttagtggattactaccagcgtttttcaataaaatgcaatagaatagaaaatagcagagtgtacaatatatagaaaggattgagtattgttttgtgacgcttttgtgtcagttttctctgtatgtgtgtggaaatgtgcttagtggattgtgatgcacaatatttttactgtgagtctctctagaagagtgacagcctcaggactagaggatttccaaggattgacatagtgggaggaaatagtacttgcaaggcccgtgcccactaggccctggtgtgttttgaagaagcattccaggttctgcaatacaaataatactctgacgttttccaagacaaactttttaaaacccacaagggaaaaatgtttttggccttttttagtgaatgttttgtactttctcccttattcttgttgctgataaattgtcttagcatatttaagaatgagtaataatttatttatataaatgatgttttgtttctttcttctcatatctcacagtgtaaaaaatacagggaccaattcacagaccagcagaaacttatttatgaagagaaactagaagccagtgaactcttcaaagacaagaaggctttatacccatctaggtattatggctttgctttacccataaaattcaggattataaaagtttctcaagtatatttgtacgccgttttgcctggtgtttgatttcagtcttagatgagtgatttttagttctgtgaatcattttataatcagcttgatgtaaacacatttatttgagctatggcttctatagtgcagtttaatgaaatgaggttacgattgttggtttcactccattagcattagctcaaacactttactaaataattagaagtcatttaacataaaaattatataggctgttaagatacgtttgcattgtaaattcctgttccttttccgtagttttcaaagactagccaaatttctgttggcaatatactttaatcaccattccagtcttcctgccatagcaagcaaggtcagaaacttatttgtaaggtaaatgaaagagcgagccaggacagtactttttgagtgttgcttgagcactggtctgtggtgccctttggtctgctaactcaacggatatgacttctgtggcctgtacagcacgttcagttcctttattttagacaccgtggactcagaaaaagaaggaacaccaatcccaagttcagcaagtgaagtccttggtaaagactgtttatcccaatagtcttacatctcctgcattcatcacttcctcccagcaatctaatcccattttcatctggtgtttataaaaaagtagattgtacaatttcaagccaaatctgtaacaactttaagcttcttccaatgaatggccaaagaaagaatgtattatatgctgagtatattcacatttattacgtaaattatgtttatattctctgtgactttatacacatttaaaatatcttccttttaaaggattaaaggaatatacattgccagactcactgggtttaaatattttaaattgtacaacttcattggttagctgatgtggctacttgaggtgatacatactcccttaagtcaaacacagtgtctaaatccaaagttgtccaaagtgcctgttatataaagcatattcaaacaggagaatttgtctgtatgcttgcttcagcaactaattttattcagctttttttttatacatttttaaattagggaataaccttcttaatgaacatttcctgtggatgactcttcagaaactacaggctggaaaatacatctttgaggaaacaatttaaaagcctgttagcatttttataatttaaaacacagttgaataggaaccaaaaaaagttaacttcaagccaagtcctttttgggtagtcttatcagttttcagggatagtggcacactcaccccacagcagtgagagaggtggaataatttagcctcccaccaccctgcaaagtggcagctcttatgggagttggccttttatatcctgagagctgtgaaacgctgaccacctacgtggatttttcttcccttatcctccacccacaacataagcatttaaatttgtatttgcaaattgccagaactttgtagctcaaaatgaagcttatagattccttgaagcagcagtttttccttggtgcctttgatgaacctgtcctgaaagagtcccccgacaagtctttagggaaattgatatcttagtgataagtgtacagttaaccttttacaaaaattagtttgtttgggaaaaaaaaaattgccctgattctgaatgtttgctttggttacttctgtccatttagaggcatattctaggagaagaggcttgattctcctttcatatacagatgctgcttaacttatgatgcagttacacacagataatccatcatatgggttatgagtgatttctatcttgattgttccatgtgatgagattattatcaaagtcctgcccaccaaatgccatgatcacctcaaaaatatatttgaaataggtttaaggtttcatttccaacttatatttaggacagatgcaagcgtaatgtataaaataaattgaagtcaatttttatgaagttgtcatatgtcatatgaagttgaaaatatcataagttgaaaatgcatttaatacacctaacctactgaacacaatcacttagcctagcctaccttaaacatgctcagcacacttacattagcctacagttgggcaaaatcatctaacacaaagcctgttttataataaagtgttggatatctcatgtggtttattgaccactgtactgaaagtgaaaaacagaatggtttatgagcaccactgtaaagctgaaaaaccctaagtcaaaccaagtcagagaccatctgtattgcctacttagaaccacagttacatgttaatattaagtgttctatagttttcttctaaagtgattgccctggatctgttctttcccagaaggcctattgattttcttattctctgcaagaaatgaaatttttctttagagcaggtgatggtaatgatttcagctcttttcactgccacatattgtttgaaggcgttagtaaatcctttgtgagcagctgttaactttatattaacagattagaagaaattgccttttccttcacatgaggccatgtacttgagtcttagctgttgttcttatgagtgatttctgtcttgattgttccgtgtgataagattattatcaaagtcctgcccaccaaatgccatgatcaccccaaaagtgtatttgaaataggtttaaggtttcatttccaacttatatttaggacagatgtaagtgtaatatataaaataaattgaaatcaatttttatgaagttgtcagctactccttagaatcaactgacctgtttcctttttttagtggtactttcatttgaaactatttctaatgtgcaggaatttttttcctttagtgttgggcaaccattccaaggggcttacctggaaatcaacaagaaccccaagtataagaaactcaaagatgccattgaagaaaagatcatcattgctgaagtcgtgaacaaaattaaccgtgctaatgggaaggtaaaaatgctaaccttgaagactgataagaagtacctattagttgggatagtcaccctgttttctgaatgtaaaaatttgcatttcatgttctcagtagagttaactatgaaggcggctatttccccttacctttaagcttaggtggaattttgcttgttctctgacatttttatgaaataaaacatattatttatgttctttactgcgttcttggtttacataggtatgtttgttgaaggatattggaatttttgcaaataatgccttaaactcatggaccatttttgagtatttgtgatcattggttttatactattttttattttgatttagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagaggtaaaggttcaacagaagatttctgtgcttaatctctcagccattgatttaaaaaatttccatatctgataatcctatcgcagtttatatatctgccttgctaatttgcaaattttggatattcacccctatgtaaaatctccgactcagtttttcagtaattgaataaagttaatcacttttattggccagtttactttactttttgagactaatacatagaaatatcaagatgttttaaattttgttttctcctgttttttcttctatgtatcaacttagtaaatgtcttaatgttcatctctaatctgggggtttacattaaaggatacaactaaaataaaataaccgccagttaattttaacctaaataatttttagtgttctgtgcctttagcttaaccaggactcctggcttggatgcagtggttacatgtaggttctggagttggtctcactcactttatgataattttggccaaggcatttaatttgtgtgtgcctacctactttttctcatctttaaaatggggatagtaagagtgcctacttcatagcattgttgtaaggattaaggattaaatgagacactggaggaacagggcctgtcacataacacatagtcactgaataaacaaaagttaacaaatattgatcatatgtagggacatgtgtctagctaataatgttactctctggccaaccctaaacttagaaaaatccccaaagcttcccttagcctgtttaccctactttggatcttaacttaaagggggcatatcaaatactaggacagtgattctcaacctcagtgacacatgtaaacagcttgggaactttaaaaattctgatgcccaggccatacccctatgaaatcaaattagaatttctcagagggggcacaagcatcatgtttttttttttgttttgttttgttttttttttgaataaacccagatgattcccttgcacagctaaggctgagagccactgccctaggatatttgttggaagtgttgtcattagggttttaaccaaatcactgaaaagttttttaatcaagtccttcagaagagttgcgggataggtccatgctcctcaaacctgaatgtgtaaacccatacctggaggttgcgttgtggtttcatattcactggggctgtggtagggcctgagattctgcttttctagcaagctccaagtgatgcacatggtgcttctgctgcatccaccgactttaggtagaaggggattaggtaaccttactaaagtgctctgagcaagttggaagaaacactgcttttgtcattattgtttaccttgggagaatggattccaggatctgatgttttaaagagactgtaagtatgtttttagccaagcctgtaaatattgaccttctaaggtatctttaattatgaccgactcttggtttgtccttgcagggctcagaagcagctagtaaaggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaaagggttaagagtcagagagtaggccaggcgcagtggctcacgcctgtaatcccagcactttgggaggccgaggcaggcgaatcacgaggtcaggagttcgagaccagcctggccaacatggtgaaaccgtctctacttaaaatacaaaaaaaattagctgggcgtggtggcgggcgcatgtaatcccagctactcaagaggctgaggcaggagaatctcttgaacccgggaggcggagattgcaatgagccgagatcgtgccaccgcaatccagcctgggtgacagtgtgagactccgtctcagaaaaaaaaaaagagtcagggaggcctctttgatgtggtgacatctgagactggtataaatttgaaatttgcttcttcaatttctcattagggttctgaatatagaagttagttatttgcatacaggttggggcatccccagatttattgtatctatctatgtaagtgttttggagaaatctgagttactgtgttgattatacttaattggttacctttcaatagattgtttacctgcttatatacttctttgcatgtctagattgctcaggaaattatattcttttctaattaagaattttctagtctattctgtttcaactcttcctaaaagtctttctaaaataaatttacacccatttctgcccctttgtaagtcagactctctttgatatgttaggattttgcagtgctgtgggcttttcttaagttctcattgaagtgtttagatttgggtgggaggttgggcttcatgtatactctatattggaaattgctgttcggactaaataacttttcttgttaatgagatctttctcataaagaaattaggaaaaaaataatggttggtgtgtttcagttaaggatttaacacgttagggcctattagagctttaaaatccctttataatagttgaagtttttcataatctgggagaatgggctttggtggggctgctaattctcactcaccatgggaagatcgtatgtatcccagacagcagaagctcctcagtgtacagacgaagcagtctcatagttgtcccactatgtgaataaactcatctttacacagaaaggaaatcacaccaacatccagaccacaaagtactgctatttttaagcatttcccaaaccgggattctaggaacattgcttgtacaggatgctaataacgatgtactgtgaaaaaattgttctctgatggaaatttaaaatctttcttcactacattacatctcagagtccctgaaatcttgttgtgattctcctgaggagctttgcggggatagcgtgtggcgtgaatcctaaacatagtcaaccacagagctccttcagcagctctcacagcttgtgttcgaaggtgtgccatctgggaaagggggacagttcgcttctgggcagcaagggccctgccctgtcacagagggcgtgtgatgttctggatgccataagctttcagtaaacagttgtctgagcgaagatttataatgtggccacatgaagaaaacaaacattgggtagcattataatgcctttcattctccagtgcctaattattgattggtctcataaaaataaaacagttcataggactctacatagcacccgtgggtcccttccccaggtggcacaggaagcctgcagaggaagtttgtaggtaaggatcgtaaatctccttagggagcattttgaatttaaacgaaaatgtccaaagtcataggcaggggcgcctgttcctttatgtgtcagccctaagtggcttcgctagctctatagaaccagtgttgaaaaccacatgcagtttagtgactaagcccttccttgctttttccttcccagaagtagaagtagttactctaacaaacctagattctgtaatcattatggataagtggatgtcagtttatggaaagagagtcaaagtcctgtttactctttagtggattttttttttttttttttttttttgaggcagagtttcgctcttgttgccaaggctggagtgcagtggcacgatcttggctcaccgcaacctccgcctcccgggttcaagggattattctgcctcagcctcttgagtagctgggattacaggcatgcaccaccacgcctggctaattttgtatttttagtagagatggggtttctccatgttggtcaggctggtctcgaactcctgacctcaggtgatccgcccccctgggcctctgaaagtgctgggattacaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagatgacggtggtcccctaagattgtaatggagctgaaaaattcttctgtctattgatgtcacaggtgttgtaatgttatagtgcaaggcactactcacatgtttgtgctgctgctggtgtaaacaaacctacttcactgccagttgtctacaagtaaaagcacatacaattatgtacaatatgtaactcttgataataaatgatgttgttactggtttatgtatttattatactatacttttttttttttgagactcagtcttgcactgttgcccaggctggagtgcagtggcgtgatctcggctcactgcaagctccgcctcctgggttcatgccattctcctgcctcagcctcccgagtagctgggactacagctgcccgccaccacgcccggctaattttttgtacttttagtagaggtggggtttcatcgtgttagccaggatggtctcgatctcctgaccttgtgatctgcccgcctcagcctcccaaagtgctgggattataggcgtgagccaccacgcccggcctatactgtactttttatctttattttagcgtgtatgcctacatgttaaaaaagttaatagtaaaacagcctcgggcaggtccttaagggggtatttcagaaggcattgttatcttaggagaagacagccccatgtgtattattacccctgaagactttccagtgggacaagacatggagatagaagacagtgaaattgatgctcctgaccctgtgtaggcctaggctaatatgtttgtatcttagtttttaacaaaaagtttaaaaagtaaaaataaaaaaaattaaaattttaaaaatagagaaaagcttatagaataaggttataaagaaaatatttttgtacagctatacaaagtattgtgttttaagctaagtgttattacaaaagagccaaaaaacagccgggcccagtggctcacgcctgtaatcttggcactttgggaggccaaggctggtggattgcttgagcttaggagttcaataccagcctgggcgacatgacgaaaccccttctcaacaaaaaaattaaaaaattagccagccatggtgacacacacctgtagtcccagcttctcaggaggctgaggtgggagaatcatctgagcccgggaaggtcaaggctgccctgagccatgattgctccagtgaactccagcctgggagacagaccaagaccctgcctcaaaaacaaaacaaaagtgtcaaaaatgtttttaaaattgtaaagtttataaagcaaaaagttacagtaagcaaaggttaatttattattgaagaaagaaaaaattacctataaagtataccgtaatgtaatgtcctaggccttcacattcactaacaactcactcactgactcacccagagctacttccaggcctgcaagccccattcatggtaagggcgctagacaagtacactattttttatcttttatgctattcttactgtaccttttctattcttactaagtttacacatacaaataccattgtgttacagttacctacagtacaataacacgctgtagcatctaggtttgggtaaatgcactcactctatgatgtttgcacaatgacaaaatcacctagtgatgcatttctcagaatgtatcccttttattagatgatgcatgactatatttctaaaatcaagttcccaaatagagtaaaaactaaagtgaatttgtttcattaaacattttaaatatatgtgtgtgtatatacatataggtatacacgtgtgtacaatagatacacatatatcatttaagttatacaattggttttctgaatatttgaaatccaaacaactaatccatgttccttttaccttgaaattctaactggtatgaatgccatgaaataatacattccatgttattgtttgttggaggaggattttctcttttctatgaggtgaagataaataatagtgcttacctcctaggattgtcttaaagcctgatctaataacatagtaaatggccaagcacagtgtggtatgtagcaaatcctcaatatatcttgcctattgttatttctagtgtgaatctttttttttttttttttgagacagagtcttgctctgtcgcctaggctcgagtgcagtggcgagatctcggctcactgcaacctctgcctcctgggttcaagggattctcctgcctcagttccccgagtagctgaggttacaggcatgcaccaccacgccctgctaatttttgtatttttagtaaagacgaggtttcaccgtcttggccaggctggttccaaactcctgacctcaggtgatccgaccacctcagcttcccaaagtgctgggattactgtcatgatccaccgtgcctggcctctagtgtgaatattaatcaggaattatagacatggaaacagttaatgtaggccaaggttattggggaaagaagttcctatacatttattacacttacaagtggtcttttttatttattttgaggcagagtctccctctgtcacccaggtcagagtccggtggtgtgatcccggctcaatgcagcctcctctgcctcctagctgcaaacgattcccctgcctcagcttcccgagtagctggaattacaggcatgcaccaccgtccctggctaatttgtgtatttttagtagagacgtgggtttgccatgttggccaggctggtctcgaactcctggcctcaagttacctgcctgccttggcctcccaaagtgctgggattacaggcatgagccactgtgcccagccacaagtggtctttgaaaataaaaatgtgaaagtgtttgatttttaaaatgtgtgaattttcaataaacctgaaagattttttttgagacacatacatacaagtatatatgccagagatatatctcaggtagttgaatctggaactatagctgtcctttcctcattgctttcaagttgaaaatgaagaacccatttaaaagatcagaagcactatccttataaaacaactgatgaattagaaacacatttgccttgtttcattctagcagataatgtttgcaaaatgtggcctctttagaccttgaaactgaaactaatggatacagagcagagctgtggatcctcacatcgctgggggatgtcagtaagtggtcagtggttgttaggttgactcactttagtaatgtgccattgactgagaaaaccatccctgagaatatggaaaatgtcataatgctatgctaattatgagggtagagagaagagatcactggttttggaactggaagacctggtttctggcccagcgatgcagctctcatgtcccccagtgatgctatcctcagttcagggatctcatcatatacagttgggggttcctcgcagcaccagcacagggatggtgtgaagaaccctctgtggatgctcaattgtacacctaaagtcatctcttatcccagcagtggtccacatgatacactgagggaaaaatacactaatggattttttaatccatgaattaatttctatacactaatggattttttaaatttttataatttttatataaatattttaatgggtattaaagatatatgtggtagatcaaacacatgattttatgcatattctgtaggtcactattattttgaaatacatttaagctagcaatagctattagcatactatgcagataacgacaaaaactatgtaggacatatgtgagtaaccagtgtttagaagccatagactagagggttgccaggccccttccttttgtgaaattctttacctcattttctcaatttgttgataatttaataggagccccctcccatattttttttttgccgtggaaaaatggaaatataacctgttggtctttccatttgaaacacagaaataattcttagcctttctaccttactagaatatgatgagttaatgaactttagttttcttagggctaaatgaggactactggaggtaaattgcattgatacaattctgtgtaagaagtgctcatgggaagaagtgatacaggttgagtctcccttattcgaaatgcttgggacaagaagtgttcccagtttcttgttttggaatacagtcatgtgtcatttaacttggggatgtgtactaagaagtgtgtcactaggtgattttgtgcaaacatcatagagtgtgtacttacacaaacgtagatggtatagcctactacacacataggctgtatattatagtatagccaactgtttatagcatgttactgtactgcatactgtaggcaattgtaacacaatggtaaatagttgtctatctaaacagaaaaagtacagtaaaaatacagtataaaagacaaaaaaatggtacgactgtataggccagctccatcataatcttataggacccccatcgtatatgactgacagtgaattaggtatgtttacatcagtcaccacaaacatgagtagtgtattgccctacattaggagagctatgacgtcactaagccataggaatttttccgcgcttatgggaccaccatcatatatgtggttcattgttcactgaaacgttgttaggtagcccatagactgtacttgcattatacttaatgtttcagtcttaatctgaaatgttccagcaagcatttcctttaagcatcatgtcagtgctttaaacatttcagagtttggaggtttcagattttcggattaggttagggatgcgcagcctgtactcgtcaagatcagtatccattaaaatacaaaagcaagtgttattgtaatcatgagctgttttgtgtatactttaatttgttttattcttttctcctaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 240 - DNA, 180009 bp, Homo sapiens; identical to SEQ ID NO: 239

SEQ ID NO: 241 - DNA, 179862 bp, Homo sapiens
gccccgcagccccgggctgggcccgcgtcccggagcgccaccggagagcgaggacgacgtggaggcggagtggcgcccggcgaggtagcgccaggcgaggtagcgcgagcgctttctctctctctcccctgcccttccctctgcgtccgtcgtcggcccccgaggcgcctgctccgcgcctttgtgcccgcggtccctggccccgtcgcaccctgcgggcgggggtcagcgggctctgccgctctcttgggagacgcggcgctgcggcgggaacggcgcacgctgtaggttgcggagggtggtcgtgactccgcagtggcttcgggggtggcgggagggaagaagggcttgtaaactaagttgctcttactttgccccatgcctctcgtacctgtgggcagagtcgaatctcggctgtcctcgtgttcacccacagcccctccattcctctggcccacagctgtttcctggccccctggaaagacacggtgtggcttcctccgggcaggaaagcggagggagaacaatggggcgtcctggggagtggggttcaggtgcggtgtgccccggcggcggcgggggaggaggggcccgggacgctgtgggcctccctgcgcgtgcagctgcgctcgcctcctttgttccgccgcagcggagggggttgccctgggtctcgtttcctgcccgggatgggattgattcacggtcccagagagggaaggggaagggggcggggctggaatggaaaccagattagagacgggagctacgaagggtggtggggccgggaagagagttggggagagggttgggagagggtgatgagagcgcgctggagaggtaactacaaacacacaacattttgttcaagggccatgtgagtttctagagcttatttgtagtgctttgttcaggcttcggcccagcgtttattgctgcaacaagttgtgtgcttcttgagtttctaggcgttcccaatgttagattgctcaaagcaaatcttcttagttacagtgaaagaagcccccccccctttttttttgagatttgaaaaaattttgctatgaactatggtattggtgtgtatgtgtgtgcctctgggtctgtgtgtgtagctagtggatattggctggaatgggtaggagacaaattttatagaatcaattttgacgtaaaattgttttatagtataatatagtacaacagttttccaggactgtttgagggcagaaaccaccagaaaattagacattgctataaataaatgaatcagactatgtaacacaattgaaaaacccttttacagtctgtcccaggaaacacaccacacacaccagcgtttggggtttgaactgaggagccctggcattgaagtgttctgtgctttcactctctgtgtgaggatcgtttagaggtggtagaattaaatgtaatgtgtcagacatttgttaagtgacctttcctagattggaatcgagactcgccaaaggattggctgacctagggagggagctatgggggattgaatgatgtgtgttttttgaatggggtattccaagcaaaactgttttgggaggaggctgacatttccaggcattcatggtttgtgcctgtgggacactggtgggaggattcccaaagtcggactgaaggttagcattactgtggtgataatttaggagacattctgttgtagtagtctggctgcagacagggctgggaagtggcccagagctgcctctttgacaagctgagggtccgccattaaaccacccctttggccatttattttgagatgaaccaagtttgaaagcctcttaaccttagaaggctaattaggagcttgctgtgggggaaaaaaatatctcctgcccactaagtggtaatggaaaagagctgtataagctactgctgagggtttgtctttttcgtgggggatgtggtcaaattttcaggccaggctgaaaagcactgggagttgtcctcaggagccattatgatgtgaagttgaaatgggatggtgtccaactgtcaagctgtttgtcattagaactaacacactgcctggcaaaacgttgtgctagggcagctaacagagggagactttttgttgttgttgtcttaccattttggacttttcacttatgctgtgaattgttttataaaatacaacacgattgaattcctctcaagtactcattgttctatacattaacaaaatgtaaagcatctgaacattgctgctactggagatgtggacagatagcagaatcctaagtggctggtctctggtctctggcctctggccgttctggtggatgcctgattgtgtgataaggctggcaacaggctgtatccccttcccaggatgaatcatcactttgtcaagcctggagttaaagactaacttaccctgattgctgcacagttatgcaaagcaaggaggaacgtctgacatcatggggaagaagagggagtgaggtgagtgggtggtgtttggctaagaagggatcttcagcatgtagcatccatgtttttagcatttgtcctcctttgggtaagattgtcttctacctcccttctactgttttcaatagctgaacatttggattttaattaaatagcctaacaataattatagctatcatttagtatgtgttcattacatgccaagaattttacatacattactatattcatcatcacaacaacttgataaagtgggtgttatcttcattttccagtggaaactgaggcctggaggagttaagtaacttgccccttacaccgtacagatgctcctagatttacaatggggttatgtcctgataaacccatcataagttgaaaatattgtaagttgaaaatgcatttaatacacttaatctaccgaaccttaaatgtgtccagaacagtcacattagcctacagttgggcaaaatcgtctggtaacacagtccactgtagagtattggttgttcatccttgtgatggtgtagctgactgggagctgcggctcgctgccactgcccagcattgtgatggggtatcgtactacatgtggctagccccagaaaacatcacaattcaaaattctaagtatgatttccactgaatgcctatcatttttgcaccattatagagtaaaaaaatcctaagttgaaccattgtaaattgaggaccctctgtgcttgtgtagctaactactaagtggtggaagtgcgattggggatcccaaagtccatactctttaggtatatactgtatggtatgatgtattttaataataacaacagtttgattatctagttggttagcccctggcagatgtcaaattactttcacgtctattattgtagttgattcttccaaaaaccactgtgagataggtttggaagcccaggttaggacattacaactcttagaactgtattgctaaagagctgtatgttatggcctgtatgaataagctgtaagtgaatgaaactttacttttaaaaagttaggttgccaacatttaaaaataagttcttttttcgaaacatttaaaagtggtagaacagagtagatcttatattgcactcaaggcttttatgtttattgaaatccattttaagccctttttatcttacagcctttaatagaacattgcactttgcttcttaactgagacccgatgccagagtgtctttttaagaagagaaataaggagggaaggaatgtgcttataaagaggaagtgggacatcagaattggaaacactcgcagcagcaggccatagatttttcccagcacatgctttttgtcctggcagtagccttttacagaaggcattcttccttagggaagtgtcaagggtctttctttacagtatcctctgagatcatcaaatttctgagctctgtgggaacactcattccacatgatttttgtgctcatcccttccccacaggggaagtgaactagtttaggcatctgcatgaaaagggaatagcagtggtatctgtccttagggtggcactgagagtggcactgggcaagaggtaccagactttgacaccaagtacaggagcagactggagtttaacacttggcatcatggattgtttgtggattcctcagaatgctcctgggcaaatggaaaagtcaatattaggtttttgttgttgttgttgtttctaagataagaatttgaagactggaagttctgccttgtttatttatttcaagctaggacaccatttggggtcttcaagttctgtggtataggtgagagtaactttagtctcctcaggctatgaaattctcctccactggctattttagacttttgcctctggaggagaggcagacacatggtttgctaaactctaacaggtgagcaccttccaacttaccataagcagcatagaggaggaaaaaggatgcttcccagcattacactcttacagcctttggtaggtctttgcagttgtcagcctcttcctcatcagttcatattttattaagcacacaggtcatgcaagacaatgcattagacccattttaaaaggaagaaaggaaatccattgtgctttcagggtcgttgtagcagggcaggtggatgcatcccaagagtggatgttggtgaaatgaagaaaatggctatgacagctgtagtgaccaagaccaggggaacacttgcttttgagacaaaagctgagaacaaacagaagcaagagagtggaagaaaactgaacacaggtgccagcttctctgacttaggttttatttcctccaatctccaatgatgtgaaagcgttcaggttcagaaccctgactgaggtccaaaaaatgatatataaactaccattctatgcgagaaggtttgaatagcagtgtcttccctggtgcatggcaggtccttggtacctccgccaactctcttctctacacacctgccagcatcccttcctcatcctgtgttcaatgtggctgtcaactaaggctgttaatagacttcaggcatatttgcattttaaaaggctcttgtggacaagacatgccaaatctccaaagaatgagtcattcacattgagttatatgatattattcatgctactgtttattaagtattgggtgcttgctttgtgctaggcctcatgctgggtactttctgtaggttgatttccttctcatcactatcccttagtaggaggtatttgtagatgagggaattgagtcactagcccagaggtcaagcctcaaagacccctttgctttccagaacaacgaagtgccaccaggtagagtgtactgtgaagctttgaatgagtactgtggagctttgggcaaaaactttgattctttgggtgagtactttgatgctttggtcacttttaaggagttctttttaaggagttagagggagagcccagctgttgtccctctccttcctggcttgtttcctttgtcacctgaagtcaggattcctgtaggtgtccttggctggtccaaagctaggagaattggttgaactgcttctcagtttatccttttctgggtgttttggcttcccagtcctgcgtcattctccttccccagctgagggagacaagattcagcctgctagtgagagactgaatagccagtcccttttcttacccccttgctggccatgcctttatcttcaggaatagattgtcatctgggagtttcagggcgtttgtctgatctctggtctccagtctgcctgcgagcagcatgccacagggcatccagtcctggagctcgctcagatctttgatgtgtgagaataagcggtgtggatgccattgcagagctgggttttgggaagagagttggggtgaaatttgtactcttccaagataggcagttttataaatagcagaaaagtaaaaattgacattcttcttttgcttatcagataagcacctgataagtttctgaaaatgcaaggggcctgtctttccttgatagcttaagagaggcttaagaggaaaccaaatctctgccttccggggactttcagtccaattcttcctggactcaagatgctttaagattgcacagatggcttaagttcgctgtgttaaaatgaaaatatagtaatgtatttcagaattgtacattacaggtttttaaatttgtttaaaaaaagaatgcaatatctttaaagactttttagaaaattgaattgaaaggacagtggaacagattattagttatcgacattataatacatttacacgtcatttgcctacttaattttcactggttacatgaaagcattttcacattgcaaccacaacaaaaagctcccccaaaatacacaaagaatcttaattgcaagattcctgctggtcccacttaacattttccagtgtacaccttctctctccatcattgctgctttgctttacattttatattagatcctgaattgctatttgtgatgttcagattgcaaatatactagcttcctaactgatcattttttcccttaaaagtacttcagagtgattggtcactgttttattcattttagacccacagtctaaatgctttaaggaaaagcttaattttcatagacattgggcctatgccaatttgcatggcttgttatttttgtgatcctcatattatctgcttctagtcataatcggtagatcacagttttgagctacccctgatatagtgagccatctatgaaaaagttctcgcttgcctgaaattttcaaagtgttgagagctattcataaaaatgtatgaactgccacgttggtcaggttcagggcttatttgccgtagtactctgcaggtattctgtgacattcaggaaggaaaatagagttagactcctgatgtcagctttgtaaaggttcatagatgtctcttgagtatctgtaattacatgatctcttaaaaacctcttatccatgtactgaaattcatcttgaattgtttatttttatcctgcattcacacaattcacactttaaagatagaacttgattatattggtatttttatttcaaattttcaatttttggaatggcagaatgttgctattgaaaagtgtcttaaaggtcaccactgtaaccccttcattgtgcttgagacctgctcagctcctaaatttaacaggggacggatctgagaaactgactccaagttgtaacctcttgcttagttttctttctagggagatatccgtctctccaaacctgtcgaaatctaaatttattacctcttacctaatacttggtcccctgtggacttcacttcactgtttgtgctaatagccttttcatcaccatcttgactttggattctagagcatcacctacttccccattttctgtgacccttacattcctcctgtcagtcactatgtctgatttattgttctcccctatcttttgccctttgcaaatcctcaagccctcattctggttcagacctttaaaaggctgagttactggagtatagtgttacccaaagtgagttgttccataaaaaattagtaagttggaaaaaaaaacaaaaaacaaaaaaataccctacccataaagttggtaaatgttcctgtaaaaagggttccttggccaggtacatgttagaatagctggttaagtttctttgcagaaagacttctcctggccttcatttgtgactgtgtactgtgaattcccaagagaaagatacagtattcacttgtcccaacttatgtcaccattgtaccacgttttggggggatcatttcgtagataacactgctatagtcacttcactgtagctttttaggttctgtcactgcctggcttcctgtgggaatgtgcattccatgtgagccgtacttggttcactctcaactgtgtcttgtgcttttaccttgttgttctggatcgttccttccccccagaagcccctctcccctatcacactggcacatctttcagtgcccagctttgtgcctgtcttctctgtcagttttcccagactcaggttgcgcttgttcttctgaacttaactgtttcacaacttaaaaaaaaaaaagaaaatatttgaagcacaatgaaatgttgaaagtaaccttacacattcatatggttaaattattggaattcccacaaaattccattttccatatttgcgtcagttgacacatcacatgcacatcacattctcctctgtttccccccacaggttagcttgcacatatgttcaacaagcttgttgcttgtggggcttttttctttaattttgtgttactgaaattgtgttgcatttaaatagaaattcagggagaattgacatctttatggtttaatggcttcccatccacaaacctcataagcttctttaatagttcttttatgtccttcaatgaaatttttatcattttgtatgtaaaactctttcataccgcttgttagatttgtgccaaggtgcttcatggtttctgtggtcattttgaatgaatgatttagtacatttctggttagtgttgctggtgtacaagaaagggattgattttgtatttgtttataaatagttcttgattgatcaagttcacatctaaacctgtgtttgctgtgggagcctgcagttgggtggcttttccaatacagcataaaataacttagcctttattgaaaatgtcataattcactttatttttatttatttatttattttttgagacagagtttcgctcttgctgcccaggctggagtgcagtggcataatcttggctcactgcaacctccacctcccaggttcaagcaattctcctgcctcagcctcccgagtagctgggattacaggcatgcaaccaccacgcctggctaattttgtatttttggcagagatggggtttctccatgttgagactgatctcgaactcctgacctcaggtgatccacccaccttggcctcccaaagtgctaggattacaggcgtgagccaccgcgcccggcctcttttttttttttagagacaagtctggctctgttgcataggctggaatgcaatggcatgatcgtagctcggtgcagcctcatactcctggactcaaatgagcctcccacctcagcttcccaagtaactaggactattggtgtgcgcctccatgcccaactaatttttaaattttttgtagaggtgatgtctcattggtcccaggctcctggcctcaatcagttctcctgccttggtttcccaagtgctgggattacaggtgtaagtcaccacacctgacctaatttaaaaattatatgcagtacttttagaagtaaggaaggggtgacttttagttatttaatgtgttcatttattaactcatcaaatgtttaggtgcctagtatgtttcaggcaccgtactaggtactgtgtttttgtttttgtttttgttttagagacagggtctctctttgttgctcaggccggagtacagtggtgtgaacatagctcactgcaggatcgaactcctgggcacaagtgatcctcctgtctccacctcccaagcagctaggactacaggcagcatctccacaccccactcattttttacatttttttgtggagacggggtctttctatgttgcccaggctggtcttgaactcctggcctcaagtgatcctccctcctcagcctcttgaagtgttaggattacaggtatgaggcactacacccatcctgtactgaatctttaatgttgaacaaaacagatgtggtttctgctctcatgaatgtgaaggggaagagacattgtggaaatggacacggataaatatgtattcgtggattagcatcgatactgtgaaggaaaaggacagggggctgtgagaaacagaaaggcggagagagggaaatttagattggggtacaaggagagcctgacttaggaaataaacattcacacagctgcctgaaggatgagttggtgttaaagaatgaggaggatggaagaactttgtaggcaataaaaagaggctcagaagccccaaggtgggactctactctgaatgacacaaagatgggaattttagtgactgatgacttaaatcaagttattaattcttagtaaattatcataatagtggtatttaacagtgttttacacactattatgacaaagtgaaggtatttattttttatcagtatatcctcatcctgccaagtgaagctggctagattcagagagctgcctctatggtgaggcttgaatggggccactgcccacacccctaccccctctgcattttgagtattgccactgctgctgccattgggtcctggcatctgctggacacgagcgtcctgctcagcaattttctcctgagctctgcactaatagacggggtcctttaaggtcaggtcaggtcaggtcggaagaagactgctctgcccttcctgggaggggtggtgagcagggccttctatgttttttccagtgtctcagccttctccactctccctccttcactgtctcttaaacacacactgagggctcaggcatgacaatgggatgggatccaaactgagttacacacctgcctagaatctgtgctctgtttggtcattgaagcattgctctggggcaggcatgactgagcttagttgagataagtcctctgtatagtgaaaagctatgtggtgcagtggttatgggctgggctctggagacaatactggtttttgaaacttgactcttctccttagtagcccccggaccctgggcttgtagcttaaacggtctgcctccattttctcatctgcgcaatgtgggtaattttgcagagctgccttctttgggttatagtaaggattaaatgaatcaacacatgtgcagctcctagaacagtgtcaggcacagagcaagcacttggtgtagatgttagttactactattcagcctttcctgcaatgctttcctggggttcctcctcccccacaccagatatttaaatctgtttgaatcctagcagtgcacataatttaggatttcatacgagggacccctttggaaaatatggggagaaagatggcaaaaaaagaaaccaaaatgttaagtgattgtgttacgataatagattggggtgacttttacttttaactctctattttctaaatcttctataacctggttatgttacctctgtactaataatataataaaattatttgaagaaagaaaagtcaggctggcggtctccagttggtttgctaaaaagggacaggagagagtgagaagccaggggtaggcctgctctagtggcattcacaggtgaagtaccttcccatttgtgcttatagttgcagaaactaggtaacggtgttgaatagtctttagcagaagtatccccaaaagttagaagatggggctattccttgtgaatcccccttttctgtgaattttttttttaatctgtcattattttccctttttgtttgttctgtgctcccttagtggtcctcttgccatatgtctctcattcagtcccctcttcctcccccttccccttgaaagtctctccttttaatccatcttctttacctactgtcatgcagaaattatgcacccatttattcaattcaaaataaagcatcagttttatttttattgtcaaaataagtaaatataacttttcactctcagaaatctaaatgaagttgccctttacttacttacacctaaattaattgattagttaatttatttgctgacaaattaatgaactctgggggtctgtgacctcctaaaagcaccaggaatcttggaagattgggtggctgcaaggaagggaagattgaggggatgttgaagttaaatttttcctctttgcctattttgcatagggttatctgtgttgctgccattttggtatatgtcagaatttttgaacttttccaacagaattctggaaaattaccaaaatacatttttacaaagaaaccatgccaaatctgacaaatttcttcaaaagcccattgattttaatcactgaaaagttcagcgaactttccagcttttctttcatgctgctctttttatgtaattgtgggtggagaaatggactttcctgcaaagtgtgtttatctacaggaatttattcttggcagtggcattttataagtatcttaaaaataatgctgacatagatttgaaagaaggtagtgggttacagtaatgttacctgctatcagctgaagagctgtttacatgaggaatattgctaatttaatgatgctacacaattgagtgtaaaatctagtggaggacatttaaataaacggaagtaaggtgatgcctttctgtaccttattccacaatttaggtattttatcttcaatgacaaatgcctaatttgaacatatcataaatatttatgatagttctttttctgctttaaggaagtctgggacaattacagtaaaatctagttttataaaatgtgtatacctagacttagcattggttttttcaaaagaagacatcataggaattttttaaattagaaccaatatatgtatcgcttaatgatgggtatacattctgtgaagtgtgtcatcgggcaattttgtcattgcgcaaacaccacaaagtggacttaacacaaacttagatgggacagacaaccgtatacaggtacagccaacacaagtatagccaattgctcctagtctacaaacctgtacagacgtgttaccatactgaatattgtaggcaattataacacagtagtatttgtgtatctaaacaaagagaaggaatagtaaagatatggtataaaagataaaaaatgttacacctctctagggcacttatgaatagagcttgcaagaccagaagttgctctgggggagtcagtgagtgatgggtgaatgtgagggcctaggacgttactgtacactgctgtagactttataaacactgtacacttaggctaccctaaatttataaaaacacaaagtaattgcatcatgacgtcactagtcgataggaatttttcaactgcattttaaacttatgggacctccattatatgtgtggtctgttgttgacagaaacagatgtggtgtgtgactatatcccctttttgagtagggcagcggttatagctgcttatttgcttttgtcacagagctacatgatgttggcatgaccttgtatctccacttcatacacactaatactgtggaggaggatcaagtcgttgggtttagcctaggcatgccaagggtatggcatgagcatggaacacataatgctagaactgccagcccagtcttaatacttagcactggttgccagtttaaaaaacaatacaaaggtataggtaaaatgttaaaggaaacttgtactaatttatgtcctttgaagtgacctttttgtgtctcatggaccctgggctgtagtacctgactatcttctgcaactcggatggagaaaatgccccttccttacctggcaggcagtgagccaggctggacattagatacatagtcgacttcacctactctgtgatttagcttccagctttaccgtttgctgtcttggcagcagcttgtgcatggtgaacttttctgactagaacagttaataacccccacagatgttgggagcccagttttgcagctgttgatatgtccagttggatttcttgaaagaattaatcaattttgaagatctcatgccgtgggctgcaagcataataggatttagggggaaactttattttatgggagtttgagttggtattgcaacagatgtagcaggaggttgaacagcagctgaagggatgcaggaaaatggagtttaaaaagatgtttgtgggcctaccactctaaaagtgtcaactgtggtcatttctgaatattcttttccaggctttttatgtgaatgttttaaaatgtgatcataatcatagagtacatacattttctatattgctacatagtatttgaaataaattttatagttgtgtattattccattgagtaccatcattttctgcagcatccctttatttttgggcatttgtattccttctgccactttgctgttgtgaataatactgtgatgagcctttttgtacctataaccttttctatattttgaatgattttctgacagtagatattgagaacgaggtgattgggtcaaagattgctgtgaactctttgatgtaatcaggtaatggatggagtgacttggttggtggggcagaaagagttggagtctgggataactccctagtttctggcttgtgtgatgttgggaatggtttgcatagacagggccacaagtgaggggttcattttgggatgtggggcattcaggcagtgagggagcttcagggactgttgaaatgcaaggtccggagcttagggaaaagccagggcctggggttcagatgaggggatcatgggcagctacgtgtggtggaagctgtggataatgttaggattgcttagagggtagagtgagaagaggaaggcggaggatagaactctgggaacatcattctgtgacaagtagagaatggagaagcactaaggaaaataaggagtgtccggaggtgggatgtggacagccagggtttcctttcttttcaagagcttactttggttaaaataagattgagtgggtagctatccctgtagagcctgggggcagatttattttggagggtataatattacttttttcccagataggctttttttttttttgaattaaagctatatagaagttaaggttattctatttggtgctgagtggggagccttatatgcatggtactggggtcaggattgacttgtatgtatgtgttatttaaactgttttggttgttttgggcttctggtgtgtatatgtttacataacattggttgttttggggtttctggtgtatatgtctttacacagtgttttagtagtctattgaaatatatcaatatcatttttacacaaaagaacatattttttttgaagagagtgaatgtcagatttctaaaagtatgtcaatcatgaatggatttaccatttagctacttacaatagaagcacccagatttttctgggagcctttgcttttttcaagagagtgatattccttttcagagaaacatttgtctgtgttgacaattttaaagaagtatgtaattttaaattatgaaactcaaatttagtttttaatagtaatttctgtgtttattctttctatctttaagagccaagttatagaatgacatgtgaccttgtactcttgactctatgtctggttgtggatttgaagtgttatttttgtgctttcctaaatgacttaagcacttatgactatatatttggatcagaataaatatggtagttggatatacttttgaaaagccaaccagatttttaacctggtaataccatagtactattcattcttatgattgtccagactcacagctttagaaaacagtctaagcttttattgacttccagacttgctggatttgttggtgttctctttttctctgtaaagtggatcagccgatgccatagatacactaatgctccaagctagagggctaccctgtagtgtgctcttgagtttcttttcccaccagttgagaagaatgcttctccagacctgactgtgttaattcccagacctgcgtgtgcccggtgtacttattatagtttaatacaatgattttaaacatgtgtgccaaaagaattgttgtttctatgaaaattcatttgaattctttggaaatcacctgataagaatgaatttccataaatgactgcagctaatttaggagtggctgagataagtaaaaaatttgggggatcataaaataaaagtatcctcactgatattatcagtcattcatgattggtgggttaagttgtgattatgtaaaactcgataatcgtactggctcaaagcagtaacccatgttcacactgtgtgtccgttgtggatcagatggggactctgctccatttgtccttaaccttactccagaacacagtctgatggggcagtaccttctggaacgttgctggtccctgtggcagaggggacgcctgctgcaaaggtcttattggctatatgcctgaattcagcaaggcgggacgtagagaggggtatggggcatttgtaaagggtaatgaggtctaccgcacttcactttccagggctctttagaacctcactgttctttaaataaattggacttggaggatgatgccttgggatggtttatagaagaaagaccattgagtacaacagtggacatatactcaaagaaaaggctccagcactataacaaaagattgacaataaatgtatatttgtagagcttcatttaaaatgacttgtttaggtatgtatcattttttatgacttccaaatttaactgacttaaaaaaaaataagccaaattgtcaatccttatgcatttggataagagaacctctactttagtcttaaacgctcctgtctctcttccacctctgtcaaattagtttcccaccttttatgatagactcatctgtgatttcccttggcacatctccttttcatttccattagcattatcctaattcttgttcctcaactactagattggggccccagatgaattccttgatatactgtcttgtatagggcctgtatgcagtgagaaaaaggcactctttggggcagacacaatcccacaggagctcaactttattttagtcaccttattctgccgccccccctcctccccagctggcccacttttatgcagtacacaaactgaacaactgcacagagcagtcctcctccctgcatttagtcgctttgccaacaaattcagactgcccatcctctgcttaagcctcctttaaatttgttgtctctattgtgctcaaaatcattttggtggctccctgtcatctgtatgtagtggctgacctcagttttatcttccatgggaccatcaccagtgactctgagccttagttgttgccatcttgatgtgtgacataagtaatgactgtagcacagatgcgctggttaggctatgtaatgcttctctctccccgcccacccattcccaccactctaacacctgtgagctccttaggtctgactcctagtctagccttggcttacctttcatcccagcttcattgttcatcaggctcctataccggccgtcctctgctaccattctgccaggtcaccgtcttctgaatatgttttttattcttgctttaaacttcttttctgcttaatcacatccaactcacctttcatggtcgagtttcacctcttcagctatccttctgtgattctcctgctgtatgatagtagctgtacctctaaacagaaatgttcatctctatattcctccttttgaggtgaatcgcctgccctatatgaacatattatactggttatcttactcttaagtattctttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttggtaagcagttttaatttctaaaccagaggggccttataattttgtcatttaaaaagaactctagtttttctacccacctattgagagacagacgtaagggtagaaatgtaaattttaagttttgatgatttataatataataatgtattttgaaagccccttttttgataaactacttgtagaaggaagttaacttttcttaatcgggtttctacaaggtagttcactattgtatgttttatttcttaccaaaacttttcttgggaaaatttgttttattgctccatacgtggtcaaggtaattaactttaaaaatggattttcctatagctttacaggttattaacatgtgctgtattcaaggagaaaaaactgtgtgtgggggtgttgtcagtatgtctccttatataaatatatgaagtaactgctgtatcctgtagaatatttggaaattagcagaactattcaaatttagttaacatttataaatgtgaattttataaacaaaaatttcagtaaacattttatttgtgacttaaaaatgattagttatggcatgtcttataggttgatttgtttgtagtgtcttttgttcttcataaatacttcagaatgtatttaaggatatgtaagaattatggtgcctttgattttaaaaggaatgcttccaacattagaaaaaccagaaattgacctagaaaatgtttccaaattctaatataattgttgattttaatcagtgtaggtgaaataacccactgcagcagtttagctattttctttaaaaattatttctcaatttacattatcagtgtcttttttggaacatcttagctatttttgtttgatcaattctcaactaataaacattcatgaaatcctaatgtaaatgtataaatatctctgcctttgtttacatagtttattggactttattttagtggattactgcttgaggaagcttctgaatttttattattctaaaaaacttttttaaaccttgagtatgaaggcattaccaaagcttcactgttgagtgatgcatattttttcccctcctttacatgtagattacttaatttgtaatctttagacttttttttttttgctttcctaactaggtgaatttttaaaagtagccagttccattttgtagctaaccatgtattgtaaacacacagaaaacatgctcaaatgtgccttgatggcctaacttacctggttattctgtgcatctttctgtgctgtgtatggttgcactcttaatatattttattttggttatgagatcagaataaagagagctgctttcctttgcctctgagtaatgtcactgagagagattcttgtggtctggcatttgctggctttttggtttttaacattctctataaccagatctaggatgcatgctcatcccagaatgagcaaactcagtctttccagagttgagccttgtttttttttgttgaatcaacagcgttggaagctgggacaagatcctaggagatgatgtgttatacgctttgtgaggaaactgaggcttgaaggtggcagtgtgcccagtgtctcactgtgagctagctgcagagctgggcctgcaacttggatcttgtggatgttttttccagaaccactgcagtagtcgttgtaacctatgatctgttgcagaatgccaaagctgttgttttctggagggataattttcttccttaacctacaaacaagaatagtgcactaaattcagtacatttctctccattgtcactaaaagagcctgaacgatgggaaggcccctgtttttttttttttttttttaaagaaggccattctgccatagtgtatcccaggctgttttatgtgagtgtctttgttcagaaccaatccggagtggcctccaaaactaatgggtagaggaaaccctatgtgagtgcctaccaggtgcaaatcactgtatttttaattataatgaaggtgtaccttgagtgattgcatgatccgatcaggcataaagagaacagaggaatgaatctacaagtggtgtaagactttgttgaggatcttagcacatggaatgagattgagaccctctgattaataagctgattcatttggaagggaagttggttttcctctggtggctatattcaattcagtaatcaccagtctttcttggcgtctgtgcacccaccaggaacaaatcagagtcgggtgtgccagttatatttgaacagttttacgttcacttaggggttccggggtctcaggtttgccaatctaaacacattgacttcttggaatttttaaaatctgcctcgaaggaacgcattgaaaagtccgtgcgttataattagcatgttcccctgtacagctgagtttgtgtttctggatgtaacagcggtttatagtttttggctgcctcgtccctcaggaatttgtagccttttttcagacgttagctcattaattctccagtcattgtgagctgtatagcatgacgaccggttcccctacagctgggctgcatgctgcccattctggaccttctagggttgtggcaggtggggggtccatgttgagggggtggagagggaggcagggcatgactttcagacccagccttggagtggggtgtgtgctctctgaagttgacctgccctttggcagccattcctgccatgactctgtagagcttcctccgggaaatgactgtagggacagtggtgttggctgcatttcctccttagggtgttaaacctcatgtaagatcaactgcaaatgaggtaactcactaggttagttacctggacacacctgctaggagacaggacagaagagtaggtaagctcttcagggtgagaagaagaaaggggcattggagagggagaaattcatctaatgagtttgctctctcagtcaggctacataacagccctgtggaatagatattgtcatccctgagtttttagattagaaatttgaattccagagatgaattcctttggattccagcctgggtctgtggctccacagcctgtgccgtaccacaatggggtggatcgaaaggatccttggtggtaaactattgctgcaagccttctgtaatatagaagcaaaaactctttgaaaaatggtgcagtgttgtgaagagcttggtgatttaggaattagactgaagggtatatgtaatagaataggtgtgaaagaccattttcagacccgtcagaaaagcttcatcctcgccctggctcttctagaaaccagctggctccaccgccttcttttttaaaggaaggttttgcctgggattctaaggtctctctccttgctctttaattataaacaaaggcacttagaaattttgcccttacgtcacaagtgagagttggtaactggtaatccaaaaccttccatgttgttatagcagccgctgttatttttgactcaatttcttctaattagtctagatggtatattttgtcattctcactttacacagttgggaaaaaacttttttccctctcgtcagtttgcaaattgtaaggttctagatgctgtctttcagtccttaatcactggcctgtgcctgggattgagggtggttgattaagggtatctccttgttgatgacttttattgatgtaaggccagcttttctatactcagacagaaacagaccttgatcttggtggtgcctgtccctctctgcctatgcagagacaaaacctagggtgttaacccttagataaccagaatgttgaattaatagcccctcccactcacagctttttaaggttggagtcaggtatggcaaatgggcttccatttgcttttatccatttgtttgttttcacttcctgtttaaatctattggatttcttcattgcctggtaatttcatgtcctttgtattagccagaatttgaacacaagtcaacaacatactatatggaaattgcccagtagttgtgcctatttcttccataatccaagattttaacaaaagccctcctactagcattccattagacattttcagcagaaagctttagagaaaatgaggtgaggggtttctcaatatatagttggctttcacagtgaatttaaggattggaaaatgagagaattataattggtgaggtaaatgccatgaatagacacaccttatataaatatctttaagcaagtgtgtaggtaggaatgaaaatcagccatcacctaagtctttccacaaatgcatgtcggggcactcactttctccaatgctttagggagccctgcagggcaccccgtgtggttctgtgtggcccaccagccccatcacctttgagaataatgctgcttgagtaaattgtcctatagaatccagttttcacccagtttgcgtttttggttggtaaatactaaggaagtgtcttgtcctttggtttctaactttaatccttcatgaggacattcctggtgtgtcatcgaggctctctgatggtcctttgccagttatgacctggagtggaagggtagcgatgatggaaaccgtcctggacagaagaatgggctgtgcctgtctaatatgcatttatttattcattttctttctacacaccagagccctgtgtgtcagccacgctgttaggcatggggcttgtgcacattgagaacttaaacctcccttctccaggggaagagcagacaaacaaactcacaattgtgagggaagggaagtattttggcatattggtctgattgagctgctgtaacaagataccatggaccgggtggcttaaagaacagacatttatttctcacagttctggaggctgcggagtgggagatcaagttgttggtagattcagtttctggtgagggtcctcttcctggcttgcagatggctgcctttttgatgtgtcttcacactacagagaaagagcgaaccctggtttctttttttcttataaggacaccaatctcttcatgggggcctcaccctcctgactgcatctaaaccaaattactttccaaaggacccacctccaaatatcatcatactgggggctagggcttcaacataatagattttgggaggacgcaagcattcagtccgtaagatttggcttgctcacagcatgtctcctatgaggaatggttattgacactggtttaagttggggggtatttatgtctgacaagaggctcagtggaacctctcgagggcctacagctagaaccactctgggcagcaaaggcagctgttctgtctgcctgccatggtctgtcaccatgcttcattcttctcttcagataggcttcctctggaggagtctgggaaggttcacccgcatgatagctgttccctggatctctatgagctccatgctctgctgcccacagccacctgactgtggtgtctgtgtcctgctggcagatctttggaagctttgtttgggctggtgtatacccaccactcagttagctgtggtctggctgaaggtgctgtggcaggccttggcatctttgtgtgtgtgtaagtggggactgtgcaggggagagattggactaaggagaaaggctgtggaatcatgtgttctctgctaaggaatttcttttttaacttggtaaaatatacataacataaaatctaccattttaaccttttttaagtgtacagtttagtcacattaagtgcactcccactgctgtgccgccatcaccactatctctagagatttttcattatcccaaactaaaactgtagccgttaaatagcacctcctcattactctctcctcccagcccctggtaaccaccattctttttgtctctatgaatttgacttttctgtgtaccttatataagtgggatcgtatatttctactcttgggactggcttatttcacataacttagtgccctcaaggttcgttgatgtagcatgtatcaggatttccttcctttttaaggctgagtaatgttccattttgtgtatgtaccatattttgtttatccattcatccattgatggacacttgggttacttataccctttggctgttgtgaatgatgctgctatgaacatgggtgtaccaacatctgtttgagtgccttctttcacttcttttaggtatatacccagaggtggaatttctcggttacgtagggagtctgtgtttaatttgttggaggctctgctaaagaatcataatgctggctgaaaggcactggagagttattgaagggtttgaagcaggttatgcctaatcagattgtgatttgaaaaagtaacttgggtggtgtgggctggggaaaaggaaagggctggcaaggctgtggtggcgagacaaggcagagagaccccttagaaagctcttgaggggaagggatagaagtgagcttaatcaaggtgatacagtcagtgagacagattggatatgtgggaaggaaggaagagacagggagaagccaaggatgagaacctggatggatcaattgttattttgtggaatttagagggagtaagatttttcttgttttgttttttatattttggtgtgggatgattgatacaaattttggaaatgtgttgagctgttagacacagccaagtggtagagatgattggtaggcaggctgtcgataatatgggttgctaatttggggtaaaggagaaggtaagaataaaggagcagatggccatgcaatttggctgaatttaaaagtggtgggggcattatggatgcagcgccacaatttcagctcctgaggaatgatgtcacattcctaccttgagacaacatatcaaaatttacaaaacaaggaaaggtggccaattcattggttgtaaaaaggagctttcaaaaggattctaataagttcaaaaggatttagaccgaagcataaggatgttgaatttggcttatagtctttttgctcatctatattttctagtttttttctatagtgaacatgtattacttttaattattaaaaagttccttgaaaatttcaaaagtggcctattttcttgacttttctattggaccgtgagttcctagagggtgatgcagggagggggaggtaccacgatgttcactgtgttcttagcactttacaccatgccagcagcacaacaggcctcaatactgtaaaagctggttgaactgaattgaatggaaatttaatctaacccctctcagagagatgagattcggtgctattttaaaagatctaggaaggaaattccagtttttctgactcccttagctcattatattaggtactgaaccacatcctacagacttggctcctcttttgcctttgttttgccatcaggatttgctgagagttactgtgttcatgaaatcttgccacattggctccattttcttacctaaatatgtttctcatgctattcttaaaagcattagtgatcttgttgggagccaagtagctcaattctgtttcctgccctttgttgataatatgtttttggaggaatggatcaaagtggcttgaagccactgtcattgttttgccttctggtctgctgtgaccaaaccaaaggatggcagctgtgaggacgtgcattgttgtacgactcagttgtcaatcggaaatttgcatacttgttttccctttgtatatcactgaatggctaccatgtgcaagaggctgtgcactgtgctttcaggaaataaagatgaataaggcatgattcttgacaccaaagagctgattttctagaaaaggtgctgtcatgcatacatgaccactatacagggaggttaatgagtggaactggagtcagataaaacacacttgttactatgcgaagaagaatccctgtaggtgctgtctctggtgtatattgctaatgctgttatactgctaatgatgttataatatatgtgttttaaatgtcctcatttacaattaccaaagcaatagataactgctttcactaagttttcctgcaagtaactcttttggctttgttttaaaagttcctttaggctgggtgcagtggcttatgcctgcaatcccagcactttggaacttcaaggcagaaggatcatttgaaacctggagcttgagaccagcctgggcaacatagcaagatcttctttctatttaaatctaaaaaaaaaaaagaagttccttcaaatttaaaaccatgttagtgatttaatattcttattaatcattgcaacctcagctctgatttgtgaatattctttcaaattctacgataaaagtgtttcaacgtatacattgttcttatctgtggtactctgagaacttcaaattcaatggaggagcacgagataagatgaattttattttaacttatcatccatctcctcttagttattatttaattattaatttggaataactcctttgtagtaccattttgatattgaatagtggaattaccatgctggatgtgctgttttgtgtagccatctctgtgtgttggggggctatgttggtcttgacattcccaagtgcagatgatgttgacatatggtaggtggcttgcaatttaaggttagtgattgggtagactcattaagtttacgtggtaggtcacagatggccattttcagatgctataggttgtttatgctgcattctcttggattttgaggaacttttgaaatgctgctgtcagtattttaaacggtattttaactttgcaaaagataccagtaaatgaattagtgtatgttgaaatacaggtagtaattttggaagttcttgagatgagagtagataggggaaggaacaattgcaataatatattttgttcttcttggatggacagagagctgaaaagaactggcacagcctgtggagttgcctggcaccagttggcaggcttgtggctggcctaaattggtacccttagatagagagactgcttttctggactagtagcccaaactgaatatactgccaagtcccaaagttttgaaactagaacatggtctgataatttctttcctggccttggtactttgcagattgccatagttcttggtagtagaatccacctggggctagtaagaagcgtaagaagcagtagagtgaggtggcacctctcctgggctacatctgcatggcagaagtgcttatttctttctcaggccacagaggcagaggtggtgcttgggataggttacatctctatgtctcccacctccaggcagagtgagccctctgagcagtgccatatgttttcctctctggcctttcagacagtccagtttcacagcaagcttatctttttcttgtaaatccttaagaaataaccaacccatactctggcatcttgaatttttttcaaattctctaatgccacaggcataaaggtccaagtctcaagataccacgggccatggtttagtccactatttcactattaaatagcgaagatgatcatcttgtcagtccaagacagcaggtcctcatgcctgtgccttagatcagccagtttttgctttttggtgtattatttagaacacttcacttcctggtaccagtctcttactaggtaaaatgctttttgttgcaaataatagaaaatacaactcaaacagcttagacaataaagagaactaattggcttacatcactgaaaacttgagagatgggagcaagcttcaagtgcagtttgatccagaggtttgggatgtcatccaggctccagtactaataattctaggtaattttctttttctctttttttcttttgagacagggtctcactctgttgcccaagctggagtgcagtggtgcaatctcagctcactgcaacctccacttcctgggttcaagcaattctcctgcctcaacctcctcctgagtagctgggattacaggggtgtgccactaccgcctggctaatttttgtatttttagtagagacagggtttcaccatgttggccaggctgatctcaaactcctgacctcaaatgatccacttgcctcggcctcccaaagtgttgggattacaggcgtgagccaccgcgcctggccaattctaggtaattttcttgccctgtcctcctccatgtgtcgtcttcctcttcctaccaaccctcctcatgaaagtagagatggctgcagtagttccaagtgtcacgtctgcaagtcacgccatccagagacagagaacctttgtcctggtatttgaagccacagtctcaagctcagtcacgtgtccagccttgaatcagttacactggctagaagatgagaatatgttgattgacttagcctagatcacatgttcatttttggtacccagaacagcatggattccttgtgagggctcttggaagggaggaggtagatctataacagtatgtgtccaacaaaaagtatccccagtgctctacatacattctcatttaattctccctagagccccatgcgaattcttctaatggtttatggaaatgtggagttagcaagtgattctgaaacttgtgcccatggtaagcacatagctccttcagagaaaaaaacaaatggatccttttggtggagcaaatacatgaactaatttcattgacatgtcaaagtgaaccaaaccaaggctagagatggtggtcacaataccagaaaccaccataagaagatatggaaatacccccacaccgtttccttagtgtcctatttttaccttgagaatgaggtaggctgtcactggatcttctcccagtgtccctaaatgctaaaaagataaacaaaacaaagcaaaactgtttgcatgattcaatgactcttggtgtcaccttttcactgtggcttgctttattgtattttggtttgcaaaatacaatattcagaggtcttcactgtttaccagttacctgtaactcagcatttcttttgcactctattcctctttggattagaaagttgggatgaggtgtaaaaaattagatataaattccacattggaaaagatggtgaagcgggtaattacagagaaagattggctgcttaattattgttacctgcagggaagctgtgttgtctttctgcagctgttcctataaatagactatatacaggaatccaccccagggcagagttcctctttgcttaatttaaattgctggtttgaggtagttatttttgaaacccttctcaggttgacttcccccttaatccctaagccttcttccctcatctgccaaattatatgtaatgcatggcagctagagtgcttttggcattacatggagcctgagaacttgaactttgattcaaatgttaatttattgtggacaaatttattgtgacaaatggtcctctccctgtgcaagtccttctgtggactctggctctggcttcaccgtctctgtggctcctgctgcatttccatagcatggcacgtgcctcccaccctcatcagttttgttctgaaacagagcccagccaacttcaaaatatacagagcagttctttgggccgacgttgttgagttttagtggtatctgggacttttctttctttcttttctttttttttgagacagagtctcactctgttgcccaggctggattacagtggcgcaatctcggctcactgcaagctctgcctcccaggttcaagcagttcgctgcctcagcctcctgagtagctgggattacaggcactgccaccatgcccggctaatttttgtatttttagtagagatggggtttcaccatcttggccaggctggtcttgaactcctgacctcatgatccacctgcctcagcctcccaaagtgctgggattacaggcatgagccaccgcacctggcctatctgggactttttgttccaggtgtatttggcttaaaattataaaaaacatacagtaacaaaaaagttactctattgtttttctttttagtgttaaatacttccttattttatttatgggagaacctctcataaattcatcttagtctctcttttttggcttttcatagccaaaaacttgttttaataggatcagtaaaaaaggatatgtttgtgggttcatataaattgctagtaattaataataatgaatttcttaattactagcccttcctagttctctttaaaccagaccaactaaatgtagtttctgctgcttctacaagacctactggatgttctagactagaagtgggggacatttgtttaagttgctgagatttcagtaaggacaccaacctttataagacatagtgtgccgaagtgactccttaataggaagaatcaaatgtcctttccactcattatcagtggcaggtatatatgtaagtatttattagtattctgaagtgtgattgagtatcagcacactgaagttatataaaactggcttctacattagaaacatttagagagaatggcccagatgaatttagttttaccattttaccatttagttctggtaatattaggaaaaataatacagacacatgtgtgcatacacacatatcccacacactcctatgctcagaaatttgaaagatttttagtactcttgacagtgatcagattggaagccttggggattaccattctgctgttgggtggcaccatgcacattagtagcagggtagaatgctgcctttgtagcgtgcctctgtttccacttggtagattttcacattgaaccaaagggaaactgtagtatttctggtctgtttactgcgtgttaatttgattctgctgttatagtggcatgtctgttggtacaagaattaaaaacgtagaggccacttttatcaggttatgttatactggtagcctgtgatttacaagtgggttgtgttcttttctttatatgtcagtattgattgtctggaatgaaatttcctcccatagatgccatgttagacgtggtaattgagttctttcacatcaaatgcaaaacatttttaagtaaccatagcaagtttcataatctctgagcttcaattttcttatcttaaagtgggaatgacaatacctacctcatagagttattgtgagggttcaattaatgtaaagttcttggtatagtgtctgatatgtggcaagtaaacaacaaatgttagcagcatcattttttatcatcttcgaggaagcaggttcatatagtctgacattggtacacaagggctgagggaaagtaggggtgggttaggttttttttcctccccctggagttttgcgactctctgctgaggagaagaccatggctttctagtggctttttctgtaggtggacttcaccagggaggatggactgggaaggaggttcatttgtggcagcaggttggcaaatggggcagctgcagccaagtcagaggctcctgatgtggttcatagggaggagaggttatgacattttttaaggctagtgagagtcatttggagctaccagtgttggatttctgcagtagtgccaagaacctatttgaaattattttgctcgtttaaattgacccctttccctctcttctgcagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacgtaagtacacacgaaggtcatctgtaatgtttagactttgtattttgtgccagagagctgtcttttcttcctcagactcttctttcttttttctctctgtttgagtccagcagtatttgctttataccctcagaaagagttgagtttttactgatttagcccatgagtaatgtgggttagacaagtcagtctgctttctgtgatcaactgtgtgcaagtattgtagtgggtgttgggggcattctaaagcaagcagaatactgccctctgaggaatttagaaggaattttgaaatccataggcatcttcttggataccttcataagattaacaaagtctaatcagggagaagctactcattgaaatgcaaggcagtaaactgtcaaaaaagacatgaactttctcgacatttgtagttagtagggacaggagcagattatcagataaaaatatgtaattggtccctgaagatttggctatagtcatgtcctactgtacaaaagtctaatgccatatacataaacagaagcataaatatgtatatgctataataggagaaaatttcctgttgtaaaaagtctttataaaggatttcacagggtcaagttctctaaatattttaaaaacatgaataaaaaatacatttatatgcagcttttctggagtttgcataaagcatctgcagaagtaaaggtgtactgttaactaaaccaaagaaatgaggcattgattccctgtacctgcagctgagaaggaaacagaatgttttggatgggagtagttttagtggactctgcctcacttcctgagttctctttcctcctttttaaaatgtgcatctgtgcatggagaagaactggattattgggcatgcttaatatttttctgtttatcattctagggaggaagtataaataaataaaagagataatacagtgatacaagtaggatcagttataacttttgtggaactaatatattttgtaaaattatatgcaaattatgagctatattattttatatcatagatagctctcttttctagatagccaactctctttatctgttggagctgcgataccaaaataccataaactaggtggcttataaacaacagaaatttgtttctcaacagttctagagtctgggaagtccacggtgaaggggctggcatattcagtgtctgatgaggacctgctttctggctcacagatggcgccttctaactgtgtcctcacatggtggaagaggaatactccttcataagggcactaatcccattcatgagagctctgtccttatgacctagtcacctctcaaagccccacctcctagaaccatcacattggtgactagctttcaatatataaactttagggagatagaaacattgagaccacagcaccaaacatgtttcaaggatgattttgagtaatgtatttatgagatagtagtcatcctctaggaattgaccttttcattcttctcactttgtattggtggaggtgggggaaggttgatggtaacaagaggcctgtgaatactgcttttggagtcttaattggataactggatactaaactgaaatgtgtttacagttcagagatgcgattatttaaagtgctgatccaaatggaaaaggtataaaacactgctgcagagcagggggtggcattgtttggcttggcagtactgcctggtgtcaccttccctccaagcgtagcagttctgctttcaggtgggaaagctgagggttctgcagctttaattgaaagtatgctctgatatcaaataaaagacagactttaaacattggtctttgagatggagataggcagaatcaattatattgtaactaacgttaccgatcatttttctttttggctctgagaagcacaattcacttttaaatgaattgaaaataagatggagagtagaacattacgtgcattcaaatacctgatttgttgtggccactaaaaataaaacaatcacctttttaacaaaatgccaagtgttaacattcatgagtctttagcagacgaaatgtctggatttcagctctatgtaattttattttctaaacgtcctttgtgtttataaaacaaaagcagaaaattgatttcagcttccagatattcatatcaattaatgtttttcatgataattcagggctactgtttccatgagatgtgtgcctttgttttgtaacttcaaacacctcatgttggagggctgggcattctctattataagtgaaacaagagattgtaaagtaatgcgtatagtatgatccttttgtaaaagatgtgtatgggggtttacgaatatgtacatatgtttgtatatatttgtatgtacagagagacaggtatgttaccttcaggtaccatagtggggtgggttgggatagggcatggggacagggaaggttactcttttagacctctgtattgtaggacttaagtcaatcatatattgcttttgtaattaaaaaaaagctgcatgataaatttgattaccacactctccagccccacatgccatgtattcttccctggtgaaatctatttctggctcttatcctgataatactcctgctttgcctttgttcatgggttgctgcaaagttgtctagcttgatgcccaaggctaagttaatatgacatggaacattttactgtcttctgcttcactctgtttttcaattctttccaagaaaatgaagatgcagttaaaaaaaaacatcttttaaggtcttatagcttcattttatattataaaaatgggtgactctctagggatgatccatcatgtgagcatattgaacagtaatttgtatgtttagagctatgtctgataagggggccagtgaacaggaagacccttgccccagacttttgaactctggatctggatacacccatagcctcagcaatctcctatgtgaaccagctctaaatcggggggttcagttctaacatcctgccatccatctcctcttctcctccctcccccaacatatttagaaatgaaaaatagtctgtatcttcccagagctctcgtgagggattgctttgcccctgggtatgagttacgactctctagaacattcacaacccctagtgatcctctggatctgtagcagctgacgctggaagcagactcccttgtcatcctgtcgtactaaacctgaagctctggatagagcaaggcattctggagttagttggaaatgtcaggtagtgttagaatgtgctttttgcaagtagccgtcacacccacatttattcacctgaaaatccagaagtcattctgctttcacaattggtttgatttagtggctcagtggtatcactaaggactttgtgacttactgtctgctttgccttccttggctgtttctttgttctgaggcttcatagtagcaaaccagctgcagcattccaggctttgcattcccgcatcgcgctggctagaagaagaggcagtgctgcttctcttctggcattccaagtcagagtcctgagatttaccttggttaggctgccggagtcacactcccttctcaaaccattgactgtggcccggagatggcatgacctgagcgacttaagaaagtgatgtttaagattggagttgaaccagatttttccaaagtagataggctgtatgtgagggggtgggttcccaaccaaatatatctattcacacactaagaagagaaaaggggcagtggatgccgaggagcccactcactgtgaactcctcaccggtttggtagggagttctgtaatgaagtggcttttttgatgttgatgtcatgttaaaggatgtgtccatgggaagaattggtcacttgagttctaggcttcaagtgcgcccaatggcttgcttctcagacttttctgctggtgaacttctaatggcagagaagagtaaacagcttcccccaggaactctggagcatggtcgaagtcctgcttcagggaaattttgccgaaatgtttactttcaaatgtaattcaaagctttatactgttctctagtgcagatgggttgttttgaactaatataccccttgtaaccctttgagtaagttgcatgctccagaaatatctgttcttcactttgaggtgggttgacacacttgtttaaatagcactggattggttcatagccatctgtggcctggttgagtctctaaatctgggacagtggcagatattgacgtggtcttcgcagttagggcttgggctattcagttggagatggaggaggatcaggtgagatgagatgggggaaatgctgaagtgatgctgcaacacacagggtcagagactctatttgctttttattcctccatcttggcggagtgtggttcaagctgggcccagctgcaggacatgctgtttggtctgacaggctccgtggggtcaatggctgggaaatgctggtcgtgacgttcccgagcactgcttttctgtttgctttctgtcctttgtcagaccttcttccggcctcccctccccggcccccaggccagatggatggtagcaggatttcatgtggacttttattgtgatgtaggagatggcagagctgagatccggccagacatgttctgtttttagggtgactggtcaggactgtggttctattcaggaacaggaaagctacaatttaggcaagaacaaggcccagtacaaatttggaaaccagagaaccaaggtgtctgttctctgacgagaagtatatttggtgctgaccagtaaatttagtttgttttctatctgaattgtaagattggggatcatctagatataggggcctgagttagtctaatttttagatcttatgttaaactaattgtagttgtaggagtgactactttaaaagtataggaaaagttgtcttaagttatagaagttaatactagaattaggattcccaggatgagattagatacttttatgaaagatactcaagatatagtaccatatatttgatttaaaatattgtaaagttaatgaaaacaatactgattaacacatttatttgaagtttcaaaaccacttttcatttatacacatgaaaatcccacctcatgggtataatctctgttcctgggaatttggcgtagatggagtagtagttttctcttgctacaaaataaagtgcacagacttagcaacttagaataacatacgtatattatcttgctattcctggggtcaggagttggggcctggcttagctgagtcctctattcaggattttcccagctgtagtcaaggtttcagcagggctgcaatcttatctgaggcttgaaccttttgcaggctcatggtggtggtggtggagagcagggctggagttcagacaaccacctgagtgttattcctgttactcagccctgttctccaagttttattctttataaaattttcctttaaaggttttttaaattacaaaataacaaatgcttttgggaaaaaaaaatttcaaatagtacagccagacatatcataaaaatgtagttttctcccttcagtaccacaggcccattcccagcgtgaacagtaattaatagaatgatgtgtaatcttcaagattatgttgggtgaaaaaactaattttcttgttctagagttggaagtaggaggaggttctcttttatctagacgggcagacctttacccaggtaatccagacccaacagagtttgcatggaacaagagcaatctttaatgccacctccaatcccacttagatgaagtagggaaggaaggaggagggatcccagccctgttaacatgaaatgcctagacttggttgtatgtgagtggtttaccatcagtagtgctcagcttactctgatcgctgcaaaggtagaccattaaggtaaacattgagaacaaattgtgtgtgccttccagagtgtagctttggtgtttgaaacggagacacagctttagaagcctagataaagctgttgaaaaacagcaaatcatgagggtgaagggaaatgtcatgtctaatttctgagcaccatctatctcttggacagtcatttttgctaataacttgccagcttcaacccatgcaaactttcctacagcctttggtgattggaaaatttcttcctcttagaattttcaaagttgacacatatttgttgcttaccaaacttagagagttttttcatcatggaggcactgtatagggcttgaaatatttgtataatacttacagtgcattaacttaaatattctggttgaagctaaacctaaggtttgatttgaagaaattaaggcctgacatcagatcttttggaagcagtatggtagcactaagaagcaaaaacttgacgtctagtcctggccctgccacttagtgagacctgggacaagttaactccttggagactgttttcttattggttggtaaaatgataaatgataacaaaggacatttttgatttccttattggtaccagctgctgttctaagcactttacatgtattattcatttaattttcactagagtcctatgtactataggtttttaaattatcttcattttacatatgaagaaaccgaggctcataaaggctaagtaactgtccacgatcacacagcaagtaggtgatggagctgaaactcacacccaggaagttcagctgcagagtccatgctcttaatgatagtcctgctgactttccatggttgctgtgagcatcaaaggatactactgatacaaaagccctttcaattctcaaaataattgggtatgatattgaagaatgtgtaggtttggaatgaggcaatctgaaaatgacctggacaaataatcaaaatgataatcagtattcctgccatgtgttgagctgctcagcagtgcagtgacatgaaccagcgtgacatagagcaaggacattcatttctaaagtcataggtgatcattacatggtgctctcaattcaaaggaaaagtgatagcagccatgacaatgattttttccccactgtggaaggtgggagaagatactgggaggaaagtatatttcatcatgttcacaggatgacaggtaactgacagctgcacatggctcttcacctttatgagcacgagagaggaggaagaggaagcagttcggcacaggggacacgtggccagttaattctgtggccagttcaactgtcccctctacacatgcatctgtgtctgttgtatatccatagtgcagaaaaattttaataatcctaatttctaaagagaggctattttgttgttcaaattctgctttggaaggagtggagggtgaaatgacatggcatactgggaaaggtgtgagcttttggctgacagacctgtttgaaccttggtgacttacagtcactgtgaccactgtaaggaatagaggttctctcacccataaaatggtcatcgtggtacttatcttgttgagttgtggtggggattaagggacatcttagtccagtgcctatcacatgatgaaagtggagtgcatggtaggtgccccgactgtctgaaaaacttggaaatccagaatcactttttttttgaggtttcagacattgatgttttctttttttcgagacagagtctagctctgtcccccaggctggagtacagtggcaccatcttggttcattacaacctctgcctcctgggttcaaacggttcttctgcctcagcctcctgagtagcttggattacaggcacatgctgccacacctggctaattttttgtacttttagtacaaacagcgtttcaccattttggccaggctggtcttgaactcctggcctcaagtgatccaccagcctcggcctccgaaagtgctgggattataggtgtaagccaccaagcctagccaagaccctggtattttcattagttagattctttctcttctccccttccctgcctacttctttccctctttctgtattcctttcatagcagttcctgtgtttcatagcagattcatttttgttacattactactttcaattaaccacagaaatattattttaaagacatattgtaaatattatccctttaatacaggaccacaggaccatgctgttaagagagttttattaagtctggagaatggtatatatttggaaaatacttgtctcgtgacacagtttgtctcaacgaagatatggcagtattgtattatcctgctctaaaataaagacgcctgaggtgatatttttagccagtatttcagcgtggcgttgaactcatatatagttctttaattcatagtctgaaatgactggctgcagcccaggaacaagagtataatatgatggtagtgtaggcacgtcttggactaggcagcagagactgtgcctgacaaacttgcggccaccgtcggcagccacggtttgcgggacgtcctggcctctgaatgagctcctgacccaaggccagtgatttaaggcacaacttagataaaaagatgagcaaggctagattctttcctcaaactttgaattgagaaatactgaaaaaataaaatatcaatgggatcaagatgctgagggtgatgaagtcgagaggagtacatgataggccacaggcaaacagaacctatgaataagaggctttgaagtggacagccgatggagtagaaagtgagggaaccagcttgcagcaggcatgaaagaaacaaggggagaagcagagacatgggcaggggcgaggctcattgataccagaactggagaggaaatcttcacaaacttgggttgtgttggttcatgagccgtcctggacccatagtcaccctcaggtcccagatttgttatagcctgggatagttgtcaggggttcctaggtgagttcattaatacaggaaatggacctggatgccaagcagctgaaagagcctgaccaagtcactgttctccgtcctattgtcatagtctttgatgcagagctttgggatgaaactctgcttctgccactgatttagaaaccttgggcaagttatttaaaaccttctaatgtttccagttctattcccctgtaaaattaggctattagcatcaattttatatgtctattgcatatgcatcacaaatatgtttctgagactggcgacatgagatgcatacactgaattacatttttaaaaaatataaggcccagatagacacctaagtctgttattcaccttatacttgtaatttttacttaggcattttgcacagttttgaactatgtctaaaaaacaaccaaagtgtttggtagaccatactgtgtctttaaaaaaaaaaaaaagaccgaggccctctgcaaggaaatttgggaaatcttacagatgtctaattaaaaacaccgtggcatatgacatcttaatatcttgtgatcaaattcccagggtctcagacccaggaaggaagtagattcctcatattggagtgaatagcatgttgtcatttttgaggattcccactggtctgtcttgtatagtcattttcttagtatcctagacttttaatattagttttattaagacataccttatgtgcttatctgaaaattcatcaatttcctgtatacaaagaccattttgggttgggtgccgtggctaatgcctataatcccagcactttgggagtctgaggcgggccgattgctttagtcgaggagttcgagaccagcctgggcaacatgatgaaaccccgtctctaccaaaaatacaaaacttagccaggattggtggcatgtacctgtagtcccaggtattcaggaggctgaggtgggaggatggcttgaacctgggatcggggctgcagtgagccaggatcgcaccactgcactccaacctgggtgacagagctagaccctgtctcaaaacacaaaacaaaacaaaacagaccattttgtaaaagtttttaagacgctggtgtggtaggactcattaatgaatttagccatggtattaacatattttatgtagactttcaagtcctgatttggctctttacagtagccaatagattccagtagagcccagctaaatttatataattataataggtaatatttatggaatgcttgctgtgggtcaggtgctgtgtttgatgttttgacacacaacctcatttaatcctcagaattagatgagggaggagctagtatgcttcttgtaaagatgaggaaactcaggccaggcgcggtggctcacgcctgcaatcccagcaagttgagaggccgaggtaggcggatcacccgaggtcaggaattcaagactagcctggccaacatggtgaatccacctctctactaaaaatacaaaaaaattagcttggcgtggtggcgggcacctgtaatcccagctactcgggaggctgaggcaggagaattgcttgaaccagggaggtggaggttgcagtgagccaagatcgcgccattgtactccagcctgggcaacaagagtgaaactccgtctcaaaaaaaaaaaaggtgaggaaactgggatgtggaaaagttaaataatgtgcccacgttcacacaaaactagagaattttgccagctaatttggagccaagacttacacaatatttcaaatacattgaagaattattattatgaaatgacataggtagaatctgagtaaagagcttaaatactatacttaggtcagaatgatgtgggttcaaatcccatcagtttcatcatctaagcccctcatcccccactgacttttcacttcaaaactgcttttggactcaagctcagactgcttacgtgaagttcaaaggctctctacagtttgatctcagtcttttttttttttttttcctggctttagcaagaattttttattccagtcgtaactactcaggggatgtctttgttttagggaagctgttccattctctgtctttggtatgtgcttgggtaggcctttgtgcctctgtctgtgttttaatctgtattctagcatgtgtcagaattcccttcctttttaaggctgaacagtgttccattgtacgtatctacattttatttatctattcatctgtcgctggacacttgggtgacttcctcctcttgggtatagtgaataatgctgctataaacatgggtgtgcagatatctgtttgagtccctggcaaattgtacttaaaaaaatatattttgaagaagatagcttagcttaaaaaaaaaaaaaagaagaaagaaaggtggtggctgggcggcattcagctatcacctgaaacctaacgtcttatgtcactctttggggggaactttgtccaaatcatgcccatctttttagaccgctcaagctgtctgtcttctctggagctttctcggacctctgcagttcatagtgacctttctttatataaccctggagcactcattagacagtaaaataatcagactaatggctcatttagccaggaatcacatcctgtttcatctgttttaatgtctagagaagttaactcttaaattttatgtttctctatctaaaagactcacttcctaagctatattataaacttcccaggcacacagacactgggagctttgtatttttcctaccatgcccagcatgatgttttgcataaagttagcccttaataaatttgttgcttgcatgtaaaatggtttgtagcctaaaatcactctatcagtcagtgcgattgtgcagccttgtgatgggttattcttacctgaatcctggcccatcctggatttgaactatagattggtgcaaaagcaattgtgatttttgcgttggaagtaatggcaaaaactgcaattacttttgcaccagcccaatactttagaggcaaaagtaacatgacttggagacccttggagatgcagacgactcctataccttctctgatatttctttgatgttattttagactaattcgtattaagatatttaaataaatattgccttttacatcaccacattcctgatttatttctctgaagttaaagaatgattacgattgaatcttttctggtgagagcaaacattttccctataactagaagatcttttccttttctgttttgtttattcctggcggtagaaggatttctcaggtggtaaaatgggaggcttttgcctaacagagtagcgctttattacacaaaggttgaagatgctttatatggcattgtgcaacacaagtttcctccgttcttcttgcgtgctttttaccaaagcttcccaggcctaacagacggcatggattgtatgctctaatgaaaagagaacagattcttgtctccttgtcttgatttcacttctgctagctaatgtggtcgtatcacttaacttctttgtgctcctttgttatggacattaagatagagaatttgtatctatctcttggggatttgggagtagtttagtagaaaggtgtgtatgtgtatattctatgccagctgttcaataggttgaggatgagtttttaaggaactccagagacatgtaaacaaataactgaaattcatcctgaagaaaataaggaagcaggtaggtagacagattggatgcctagttagagcccagcaaacagaggctttaaaaatagattttgagagaattcgatatttcaaaaaaagcatcaaagtacatgatggcaaaaataggtcattatgggattttcttacatgtattttatggtgtagttatacattttaatatcatatgagaaactgaaatgtaaaccttcaggatttagggcttctaaagatctctatcttaccctgggaagaattatgatataaaagatattaaaactattctgactttttagaagaagttttatatacagacttggaaatattctgactgttctgtgtatgtgtgctaatgtttcatttatctgcctttgcgaaggaatgttacacattattgagacttacataatattaaagctgtgctaaaatatttaactttttggttagatatcattctaaaatgtattgcatatatccttgtcatcaaaaacagaatacactgattttggctgttgattattaccctacgttcccaattagtgccataataaagcagtcagggccggctaagccatggggctcttgggtcttactataaatatttttatactttgataattatcttcatcacttcttacttattttctttctttctttgtccctccctactcttccttttctattagtggccattgtttctctgcttgcagagggagtcttaacctggtatatcacatgtatgcagacttcaatgtgcatgtgtgtttttccaaggagaagagtcattgcttccgctggtgtctcaaagggatcaacaattgaagaaaggttaaggagtgctgtgtagcacaattttttaaactgcaagtttcatatcattaattgctcatgaaaatcatttagtgggttagggccaacagtttttaaacattttgtaaaaaatattagaatcgaacaaaaaatatcaatgtatcacatatagtaaagggtacttttggttttgtgaagtttttatcttgtatatgtgtgtgcacataaatagacatacatacacatacctggttgtgatgaaaattttatttcttatatatgagttgtaatcaaacatttcaaattcacagctatagtacggccctttttgcctcttccaatatacagatgttgctgcagtttttctgtagtctattgagactatgccaagtttattagaaatgtggctaaaatgagagtgaggctagaaggacttttcttttgtttcagaactagttccataggagtatttaaaggggaaggtgaaatagaagataagccaacagcagcactagcaggttgttgcaattgagagtaaaacctggtcctgtgagtctggaagggaagggctacagacattggttttcaaccctggttccacattagtttatgttgggtctctttcaaaaaagtactgacccctggccgttccctacatcattgaagtagaatctctgaggattggagttctgaaagaactttcttatagaataaaacacgtggcctttaggttatattttgactactcaaaggcttttcgtttggcttctgaacagtggtctggggagtggaggtggctagattgaatgtcctccagaaaagacctctgttttcatggtaattatgctaagaacactcaagtattatttgattatttacaagacatctgttttggaatgctagagatacttgaaatctaggaaggtcgagatggttttgacttaagaatgtttgtgcattcttgattcagtgtctgcccttgagaaatgaaatataaccttgctatctgtatgtgccaattatagaaaggtagagcttgttttcttctccctcttccctttttcttctctttcattcttgtttgcttctcttccctcccacatctctttcctttcttttcccttcctgggtgtcagaggctggcccactgagcagaggcatagagggagctttccattgtcatattagtggtggcatggacctgagggcttaggggagctgaggttcagaaacgtggaggggtgagcctagaaatgcctgggctggttacttcataatgagttggtttaccatcctttttagagcgtgatgcaataagaaaataccaactgtaaatagtatgcagttgtttatttaaaaaatgacatctgattcacaagtccaaatgttaatcaatgtaaaaatgaactgtctggtcactatcattctgatccttgaaaaggagatttaatctggtgctgtagtcacctgaatgtagaattggtagctacctaaaactagagtagaaatgttaaaccccacccagcaatcagctgctatcaggaatgtctttctgtgtctcagaggaagcagagttgtgactgtgaacatttgagttattctactggcccatgtaggaatatttaaacctttggctaatgcacatagaactttgaggaagaaatccataaacagaaagggcaggtataggatgaacctgttaggagttcaaggttagaagataaagaggatatctgaactgtataaagtggaatggagagagaaagcatagtttcttttagtgtttgcttatttaggtggataaaacttgtcctgcttggcaccatttttagtttcttgagtcatgtaggtattgatgaaaagagtcaaactctaaaatatttaaagagatttattctatgccaaatatgagtgagcatagcccataacacagccctccttgggagatcctgagaacatgtgcccaagatgattgggacattttaggcagacatgagacttcaacctagagaggtagaacagctcgaagcagtgaggcttccaggttataggtagatttaaaatttttctaactggcaattggttaaaagagttaccaatagaaaggaatgtgtggattgctataagaggttgtgaagaccaaagttttatcacacagataaaacctccagatacccggcttcagagacaatagattgtaaatgtttcttatcagacttaaggtctgagtcgatgttaatgctggagaggtataatgaggcatgttcgacccccacttcccatcatggcctgaaccaatctttcaggttaaattttagagtaccttggcctaggaggaagtccattctgatggttgaggggccttaggattttatttttggtttacataggtgtatcagttactgttgccatgtaacaaactacctctcagaaattaaaggcttacaccaacagccaattatttgctcacgattctctgggatagcaagttagcctgagtttagcattgtatattttctgctagtctcacctggaatcactcatgtggccttaggcatctggtgtccttactggggctggatggtttaagatggcctcactcatgtctaatagttagtgtagcaggctgtaggtcaggataccttagctctccacaggacctctctgacaggctagctcaagctcattcacatcatggcttccagccacagtcataaaaaaggagacacatcctaatacacaaatgcttctcaggcttctacttgtgtctcatttgctaacttccctttggttaaatcaagtcacagggagaaattccaattgaaggagtggagaaaaaaactctatctttaaagtaacaaagtcacatttcaaatgggaagtgcatgcagggatggaaagaattgttctggctgtttttacagtctaccagagtcaaacgacatttagggatttgttaaatggtaatgttaccggaaaggagtcccaatccagaccacaagagagggttcttggatctcacgcaagaaagaatttggggtgagtttatatggtaaagtgaaagtaagtttatttaaaaagtaaaggaataaagaatggctactccatatgcagatccatttttatggttatttcttgattatatgctcaataaggagtggattattcatgcctccccttttcagatcatatagggtaccttcctgatgttgccatggcatttgtaaactgtcatggcactggtgggagtgtagcactgaggattaccagaagtgttctcatcaccatcttggttttggtggatttgagttggtttctttactgcaacctgttttatcagcatcgtctttatgacctgtatctcatgctgacctcctacctcatcctgtgatgtagaatgcataatcatctgggaatgcagctcagtaggtctcagccttattttacccagcctctattcaagatggggttgctctggttcaaacacctctaacagtaacacatggcatataggctgattaaaatactaagcactgagtatagtatatttgatcttatatttcaatgcaagaataattagatgtgtttcagtggcttgtaccctccaattagtgatgaacataccccatgtgatttggtcatttagttaacaaatatttattgtacatcatggtgggccagacactgttctaggtgatagagatgcagctgggggaaaacaaacacacataattcagtatgtgtaacagtcacaaggaacaaagagaaacttacaacttattactgtggcttttgattttgaatttgaggcaacagagtttgttccctgtgcaagaatgccacagaggcagatttttatcaagaatttagccactgtgaagtttggttttaaagagcaactcagtaagtggtttttctgctaacagcaaatcaatatattttagaaactattgtattcaagaaaaagggagaaggattcaaatagtacttttctacttaaagaaggttgatttttttaaccaatagatgttaaagaaataaccaatggctatattttcatatttaccaaggctactaattctaatgtattagctggaagctattcagacaagtattcagtgtcaggcgtctcccatctgatgtttgcttgtgacattgtccttgggagacatctcccatctcctaggtgggttgcagtgtgaggacaaccagaaaaccttgagaaagttttgtcattgtttgtgaggccagattaattgggtcctagtgatagaatgttagaaataaatgtgaaaaattgcatgggaactgagagttttcttttacaacagcaatcttgtccacccttgacaagataatatttgtccacctttgacaagatagtattcttacaggatgaaagtgtgtttatatatatatataacctgttcagttttcctagttgggagaaagtccttcataattaatatcattgtgacccctgtaaaaagaaaaaaaaaagtcagcagaacatttctacgttccttcattttctattctgtttaattttctagaaatatctgacagtctttttgaatcccagtggtggtaatactggaaaaacttgttgctctaaaaatggtaccttttgtgggatgacattggaaaggtgggaagttggagatctttttttccccttgtttctttctttcctttatgaacctttttctttttaaaagttatatcgctcatcactttatcacttagtttatcactttaccacttttgttggcaccttttttccccctcctgtcttttatgatgttgaaactgaaggggaaaatggagctgccaagataagttacagttaagtgacgtttgcttgtggcattgtccttggcattgcacagaaggaactaaaccagcaccactggtgctgccaggaatttagggtcgaagtagacaggaagagaaattgtgttctggtttaaagttcagtgagaaaagtttagtacatgctaaaatatagcactgatccctcagaaagtgcatttaaattttacattaaatgtaaatttgacattaaatttaaatgttgacattaaatgtactttctggaaagtacctttaaatttgacactaaaactctgatattatgttagatataatgagattatgtggtttgaatgtccaagagatacctgtagctctgatactgaattgaacgtgatctgagcccattgtggaaagattgacagacttgcagagggccagtgccaaagggaaggccctatgaggtgtgggtagggaagaggggaacactgggatactgttgactaaaaaggtggaaaaagatgagagaagaaggggaactatagctctatctagaatcagggagagcatggctcttgcttacagttagcagtagtttgtgacaaaatttgtggaaaatatgacagggctttggagaactcttaccgagaaccgtaaattagttcagagatatactttgaaaggattttaaatatataaatgtatgctttccatttatcaacaaactaaatagacattgttgaccatctgtcttcagagatgcaaagcattcttaaaatgtatacaatgaatggtgaagcagaactagtgttgattttaaaaggttgaaaccatacaacactaaagcttaagacgttaaaatacattttgtgtactaactaatgggcatgttttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggacatttcagaaacatttcagaaaactcagtaactggattcattgagaactgcctcagattcccaaacagcattgataaggaaaggctgagaagggagagatgagggaaataatcaaactataggttgagcatccctaatctgaaaatccaaaatcttaaatgatccaaatcagaaactttttgatcacaacatgacaccacaagtggaaaacaccactcctgacctccaaatgcagtcaaaatgcagtcatgcaacatagaattgattccgtgtccctaagagaaaggtaaaatttccttcaggctatgtatataaggtgtatattaaatataaatgaatttaatgtttagacttgggtcctatacccaagataattttgtatctgcaaatattcccaaatctgaaaaaatttgaaatctaaaacacttctactcccaaacatcttggttaagcgatactcagtcgatacttaatctccttccacttagttgcaatagcactgtgacagtgcaccttcagatattttagttaccaaatccactggccttttgtgttgggtgattgccttttaaccttgcagcagttgatgcagtttatcaccaacagatggatcttctaaaatcagatcatgttactcaccttcctagaaaccttcatgggctccctattactcccagttcctttagtgtagtgttcaaggccctttacagtccagctttagctgtcctccctgctctcctccaaaccccactactctcctttgtggaatctcctcttgagccagagccattcatgtcttttcctttctacgtctcataccctgtaccttatctccactgttaaaatcctgccagtcttctatggtctgtctgaaagacttggtcagccccagcataatccacaagggacttgcactggccctgagttatcagaccactcgtggtcgtcaacacacctcttcttgctatggttgattaggttttggtgtcaccctcttgaatgagatagaagcttctgtaggttagaaactttatcctgcacatctctgtggctgtctccagtgcttttctcttcagagctcaacaactataaaacaaaagagattttaggtgatttttcattacattttacctgtgttatggctgagagttcaatgaaatcaaaatgtacttgataggatacttgtggagtttattcaaaatttcatgcagtataatgagaatttttttcattttttaaaaaaagcaaaaatatttttatggtgctcttcaactcttaagtatttgttcagcttcgatttgttcatgttgtctgtatgtctattggaaggaacttgccaccagaagaagagtgtattgtggtacctggcaacaagccctctggtggtcatagcccaggagtgagctgagatgtgtccttcttaagttaggatataatgtgatggccatattaccttaggcattgcagtcacaaggtgaagcagtctttccatgttagtaaattacaaactcagcaacaaatgttaaaacttagacaagtggcttacagctttgaataatttctggttaccctcatttaaaaatgggtaagcaattagtgggagcacctggtatagtgctaatgtcagttgtccagaagtgagccctccgtctgtggactctttgacccctacttttgggccagactggtttttcaggatcacataccgttgcccatgagtgatgttgctataatgcttgtgtgttttgagtctttgttgatcctgttaccattttactccattcaaggtgaaccaaagtaattttataaagaacatttctgactatatctcaaaatgtaccagtgctgtggttgagtatacagaggttaggttaagattccagggcagaagactcacacattatttcttttatgtagtcagttttttttttctgcaacggagttgaaattctgtgaattaaagctgtgtttgagagctcttattgcaagtagattctgaattctcctgtagaggttgcttgtgcaactggatgtgaaagtgctttctgaagggtgtgtgtgcgtgtgtgtgttgatgtgatgttgctgaggctgttgtgttatttctttcattttacttttggaatagttgagcccttaaattgatccagtacgtctccacaaataagttgcagaaaagggttttatgctttcccatctagcattctttttatttattactgtagaagagatattcatttactgagcaaatatttattgagagcttaccctgtgccaggcagtctttcaggcactgggatacagcagtgaacaaaacagataaaattcctgtcttcatgagagaggctaaactccagcttaagtatttagaagtcaagattgtacacaccattggttagaagggaaaaagggaagagcagaggaagggaagctttcatgaaaaaaaaaaattgaatcttaaaggatattcttataaaaccccctttgagccatatctaaggcagtttaagtcagtagatgacagattgtggtctgcaaggctttgcatctgtccaggcctcagatctacgcaagtagcttgtacagaaggggattagagctttgtttgctctccagtttagatgccttaaataaacatctcgtgtgtaatgacaccatcttgaaaatagctaaaattacccttttccttttatgcatgactgtcatgggtcaaaataagcagaaggcaggcactgtgtttgttgtcagtcttgggggatatttgtttgattctggacaacaaggattagaaaacttcttgacttaggcgagtttcatatcagcagtgcaatgtccatgtggtggtcaagctctgctgttgacttgaagcttcctgaggctgggtctgcagtgggaaacatctctgggcgtcgcacctaattagcttctgtaaatgctccacgaactgaacttgctgcctttgactttcaaagttttcttcccagtatgttgctttttgtggctattttcaaaacagcttctttcagccgggcacgttggctcacgcctgtaatcgcagcactttgggaagccaaggtgagtggatcacctgaggttgggagttcgagactagcctgaccaacatggagaaaccctgtctctaataaatatacaaaattagcctggcgtagtggtgcatgcctgtagtcccagctactcggggggctgaggcaggagaattgcttgaacccaggaggcggaggttgcagtaatcagagatcatgccattgcactccagcctgggcaacaagagcaaaaccccatctcaaaaaacaacaacagcaacaacaacaacccagtttctttcaggatatgtactcttagcagaaagagacctcagctaatttttcttccagatcatgaagcttttaaaactcaagtaggaaggttgatttgatgccagcctaatgtttttatcatgaaaattgttatgatataagaatacatttattaattgaaaagtgtttctggtacatctgggcagtttcagaatcctaatttctagaccctcaattagagtttatatcccttctcaccaaatgcacatctcagactcgaaagagtttattgtaaaaatgctgtttgtgaagccaagcctatgttcacaccggcatacacgataatttcagtgatacaatcttaaagggaaaagtttggttctcagcaaaacagctgctaactgccaagatgtggctgacctttgacagactctgagaagttctgcaacatcctggaaaagatccatttcatctggagaagcagcactgaggccttggctgctgaaggattagtataattacttcatccctgacagagagagccacagttggaacccacctgggaagccttgtctagggaggtgggaggggtgctggccccaccctttgttgttgaaattggaatctttgccacaatctgttgctgggactggtgtggcagggtaagtagggccaaaggagccctgtggggatttgtctgaacaggggctgacaaaagctggtccccatccagccagcccagggaagttagcaaagccagggataatgaaagtgttcagcagagcgaatatgaggccctagtcgtgagactgcggaactgagggtggtgatggggccaccacaggggtagaaactcacgtagaggggaacaggcccaggcgtaccagccccaggttccagttccagcctgtcccagggatcccagatccccaagtgcaagtgattgttcattcatctgataaacatgattaagcatccacaacatgttgaggtgctgggaatacaaagatgaattttcccttaaggattcacaggctggcgtgggagacagactgataaataaataccgaagggagaaagcagccataaaaaaggtggggcatgtcctggtttgccctgggtagccctggtgattccttttgtagcagcataattattaatagtgctcttggaattaacagaagagtctgagaatgagcagtaagtggtgtggtcccctgggaaatggggtacagccctgcctgaggagctaggagatgggatggaggacccttaggtgatgagtttgccgcatggataaagaataggactctaggctcaggagagaattttctagtcagagggaacagtgttgactcagtcattcatcatacgttatttgggtgcccaccgtgagccatgtactagtgtacctactggggacacaatggacaaaaatcttggcctttttgtgcttacattctagcacagagagagacaaaacacaagagacgttaataaaacaaatggcattttaaatggtgacaagtgctgtggagaaacaacgtggggaaggggcatcagggctgtgggggagtcacgagtggtttactggtttaaatagggtaaccagggagtgctttattgagatgttatatttcagtatcatcgtctaggggtaagagggagagacgtgatgtgttgagagaagaatgttctaggcagaggcaacagcagatgcaaaggtctgaaggggagacagaccgagctagaacagcatggcacatcagtgatctaagttcgtgtggtttcctaaggttggaacctagggtgcaaactgaggatgggcagatgaggtagaagaggaagagcagacccaggtcacaaagaacttttgtgctaaggatttttaagcaggtaggaggagagagaatatgagccttgggatttgaactgctgtgggtgtacagaaaaagagaaactcaacgagaggtttaggtttagggacgtggtaggcttttgcagtaagggacaaggacagaaggctcatctgaggatgggagggacactttagaggcaaatccataggatgcagtggctgaacagaaaaggtgaagagagagggagaaagggggatcagagggagaaagggggatcagagcccagtcacaattcctggctgggatggagaggttcagagtcccaggcaacccctggaattgcaatagcctggagatagtcttgggaagcagtagtgggtacctagaaaagcatggctccaggtaattgacagcagataattgtatgtttctaacatcatttctgataccaggtgtgtgacatttttcccccagcaccaaccagttatctgacactaactgggtgtccaacagttcagtttgtttactggaaaggggtcccccaagagagagttcttggatcttgtgcaagaaataattcgaggtgaatccacagagtaaagtgaaagcaagtttattaagaaagtaaaggaataaagaatggtcatttcatcccatgaacagagcagccctgagggctgctggttgcccatttttatggttatttcttgattatatgctaaacaaggtgtggatttttcatgtgttttccgggaaagggatgggcaattcctggaactgagggttccttctgtttttttttttagaccacgtagagtaacttcccaacattgccatggcatttgtaaactgtcctggcgctgctggtagtgtcttctagcatgctaaagcattataattagtgtataatgagcagtgagggtgaccagagggcagcttcctcgccatcttggttttggtgtgttttagccagcttctttaccgcaacctgttttatcagcaaggtctttataacctgtatcttgggctgaccttctctctcaccctgtgactaagaatgcctaaccttctaggaatgcagcccagtagatctcagccttattttatcgcgcccctattcaagatggagttgctctggttcgaacacctccgacaaactcagttctgacactaactacacagttagcacagaccacacaggtcaaaggcttagtcctacaagagtgccccacttcagacaccagccatgaatggggtaccctgactactcacacttctgcttagtcaaccccacacgtttgggggtttccatgatcctcaggttcaataatttgctagaacaactcacagaactcaggatgatacgttttttaacatttactggtttattataaaggatacaacacaggaacagtccagtggaagagctgcagagggcacggtgggggtgtgtatgcagagcctctgtgcactctgggaataccaccttcccagcatgtcagtctgttcaccaacctagatccctccatctccccaaaaaaacagaattgtgttcaaatttttgtaacccaatctccagctcccctcccctccctggaggtggggaggtggggttgaaagattcccccccactctaatcacaggcttggtctttctggtaaacatccctatcctgatgctactgaggggccccacctgagtcccctcatttgcataacctcaggtatgggcgaaagggacttgttatgaataatacaagatactcctgttacccaggaaattccaaaggctttaggagccctgtgtcaggaacctgagacaaagaccagatacatttgtttttataccacagatgtggacatgtgtattatacattgttcttaagaagccatagaaagcttgtcctgaaatactcgaatcctggcttcctgaagccaggttattgttggagtttctgtatacaattttagaaagctgaattagtaggccacctttttccaagacatgtttaagggtagcaacagttcaactcaataaacatttgagtgttgtgtgcccaggatcccattcaacccctccaagtcatttcccctgtctactgccttatcttttttctttcttcttccattcccaccaacataacatgctgcaatgtttctcttgatttcacatctcctagctaccatgccatttgtttcctttattaccaaactgtttgaaaagttgggtatgcttattgtctctagttcatctctttttcttttgtaaatcactctaattgggctttcatctcccactccactaaaacttcttttcaagatcatttgtgacctccatgttatcaaatcccatggtcagttttgaatcctcttcttcctttatcagcaacatttgacaacatgaccagctccttcctggaacccttttaaaatttggctttctggcctccacattttcctgtctttcccccgccttgctggctgctccatatccagcctccgcattcccgtggcaagtccaggggctccactctgggacctttgcttttttcctctgtaggcattatttagatgagcctacgtgggcttcaaataccctctgtgtgctgatgatgcctcccggatttagatcttcagctggatttctcgcctgacctgcaggcgatccagctatgttgagctctgcagcatctctttggataaggggcatctcacaccttagcacgcttcaaaccagacttaggattgccccactccctcttctctttctcaccttggtcagtggcagcatcatcctttggttactcgatgcaaaactgtttttttccttttctcctattgcacactcagtccatcatcagcctgatcatcctaaccacgtccatagccacttgtgcgtgtgccaggccactaccctcctttgcttggattatgttggtggcctcctcactgtgtccctgcttcaactctcctgttgcctccgcctgcctcccctcaaccgccaactttcttatcttcatgaatgttatggccactgcctagagtgatcttttttaaagatctccatcagattgtttttctttgctgctcacaaaacctgcagcaactcccttgtggcctgcatggctccacttgatctgggctctggccacctccctgactgcatttgttacttctcaccctctcttccccagccacgctgtcctccttgctgcttcttgaacatgccactgtcagcatcactcttgtaccatagaggggctgacttgttctcttactgcaatcaggaatagcaatccctgaaatagccaagtccttccccaatcacctgttattctcttaggctactttatttttcttcagagcatttgtgcttacctgacatcttgccatgggctcattttttgttactttattgtcttttgcattagaatgtcatctccatgagcacttgcgctttattttaccatccctgtatccatagtaattagaacaatgcctggcgcagagcagccactccataaatattggtggagtgagtgaatgaatgaatagattggtggggagtgggagagctgctgttggttagaaactgtagaagacatggttttgtctttaaggattgtccattctagttgtgggttgggggtagctacataagctgcattttaatgtaacagtatacttacaaggaacaagttggaagtgcagaaaaattggtgggttcagaaattctgaagatgccacttgtgttgagtcttgaagaagaatttttttttttaagacagaatcttacactctcaccaagtctggagtgcagtggcgcaatcttggcttgctgcagcctccacctcctgggttcaagtgattcttgtgcctcagccacctgagtagctgggattacgggcatgtgccaccacgcctggctaatttttgtatttttagtagagatggggtttcaccatgttgaccaggctggtctcgaactcctgacatcaaatgatctgcctgcctcggcctcccgaagtgctgggattacaggcatgagccaccacgcccgacctgaagaaggaattcttgaagtaggtggcttttgtagtttatagaagataagacaaaagaccagttttggctatggcataatgaccctgaatgttaggaaagggaaacggtattagagttgagaatgtagagctatttttcaattttaataaaacattccaataccaatctgcttgaatcattgggaagactgaaggattatgaaggttattccaaagtaataggaggagagtttgggataaggaaattacttaaaattgcaagctatgtgtctggaaaaattgccatcttgcatttcagtcatgaactggaaaaaattttcagacttgttaaatatgcctaagtgtatatgtgtgtaaatgcaattttttaatgaatgagtggtgaatgatttaatgttgaaatgatataagtgtaaacagatgttaattcatttgttttacaacagaatttctagttgctattggtgatgagtcacaatgtaatttaggaaggggcaacatttgatatgaagaatactgattttaacctttattaactcttacgaaaccctttgaagccacccccttagtatattagtgttcattggatgcataggtgatcagcttgagatccaaaaagaatatccttgtatcctcagttacagtaggaacttcctaagccttatagatgacttagcctgctttcacataaatttaacaagagaggaataagttagagtatatacattttctactaatctttttccatcagtccacatcaacagccaaaacttaggctgttttagcacctggagggagagatgatttggatggttttgcaccacagacctctaccttgggaaaacacatgcaggcataatcataggttacctgcggaaggtcttaggttactggcttaagaccggagggtttcatttttacttttatcctctatattttcatgaaggatgggtcactaagggcccttggatgtttctttaggaattgctagtttttaagccgttgctttgccttcgaaagacatattttcacactcatacaccctacctcacgtttggccatgcagtgttgctgctgcttctatctatatttataattggtttggccgttattaatagcagaagcttatgcatatttttctcatgtgaatagcattatggattaaaaaagggacattcaaaatggcagactctcatctaaggtcagggaaatgtattaaagaaaagtgttactgaagtataaagatgttaaaggcataaattataaaatgaacacatgtagctatttaagattacatgatagagtgagtcatggctatctggttactcattacctggaatgtgggtatagggaaggaggaagtgtggaaacatgtgcatgggtgttggtcattgttcctaaaacaagtagaaaatgatatataacactttgaacatttgcctcctttccgtaacttaacataacttttattataagaatattatatctatgattgattgttaatgtcatactttgtcttacaggcatagcttaggtagcatagatgcattttaaattttgaaaatctttgtccttttctatatttagagactttaactttctttgatgtttacaaatatattgcattgatctttaataggactcttaaaattaaagccagcgctaattaaaaattctggctgtgaaaatagagaaattgagttcgataaatttgtagctagtgatcagttatacattttttttcacttggcctcttgtggcctactgtttctgaaatcccactgtttgcttcatttctcctctttcacagacactctggtctatattctgttttactcactccacatattcaaatcctgctcatcttttgcggtatatgggaaaccacctccattctgaagcctcttctctaaaggccacttggtggtccaaacacatatggtccatattgtgcattctgtcacaaccatgaccttttatttatatatgatttttattaatcatatgacttttatttatcttatgtatctcattgattgtttcctatttaagtattagacttctacaatagtaagcatctttggaagagggactatacatggatactttgttgcttcaagatcagtggtcttaaaatctgcctgtgtttggttatttatagttaacttgtcaggtaacaccatccaatgtattgtgtgtgttataaaacatacacaagactgggaatttttaaaaagtgatgaatacagaaatataaatagaagttctgatgtttatatttgtactccagtggctcatcttgggcatgccctgggatgcccacacctcactttggagacctggcattaggttcatagtaagtattcaggaaatatttatttttagccttcagctattctgtgctgcttactgacaaaattcccacctattggaaatgaaacttgagtttatagtctgagtgtgtttgagaccttgtaagggggtataaggaacgattagtcagaataaggtaggttatttttgagtggcaggccttcctagctcaaggcataacacaacaaaggtttgtttctcatgaaacacaatttgatgggggtctgttgggttttctcagaggctctcctaaaaatggttactcagatatccaagctgcttctatattgtagttataatatctggcacacatggctttttttttttttttttttttttttttttttttttgagacggagtttcactcttgttgcccaggctggagtgcagtggtgcgacctcagctcactgcaacgtctgcctcccgggttccaggaattctcctgccttagcctcctgagtagctgagattacaggtgtccgccaccacgcctggctaattttttgtcttcgtttttgttttttgagatggagtctagctctgtcgcccaggctggagtgcagtggcacgatctcggctcactgcaagctccgcctcccgggttcacaccattctcctgcctcagcctcctgagtagctgggactacaggcgcccgccaccacacccagctaattttttgtatttttagtagagacgggctttcaccgtgttagccaggatggtctcgatctcctgacctcgtgatccacccgcctcggccccccaaagtgctgggattacaggcgtgagccactgcgcccagcaattttttgtatttttagtagtgacggggtttcaccattttggtcaggctggtcttgaactcctgacctcaggtgatacaccagcctcagcctcccaaagtgctgagattacagatgtgatccactgtgccaggcccacatggcttttaagattgctgtggaaggtgaagagagagcatgataagatcttcattggccagtgcatagtcacatgggcccagcctaactgcgaaggaagctgggaaatacagtctcctcttgtgcccgggaagggagaatggaatgggatttagttaatttatcacatggtctcttgtctgctaggattatttcagtaaggttgttggctgtttggtaatttaacttgtggataccatgtaaagcaagcttctgtgtgaatttaaacatgagttcagtagtataatttagaatgaaagacctcttaacatattttcaattttttaaaaaataataattgtaatcatggtgaatttccacatttccagtttaattttatttgaatgcatttctacagaagtaaaactgttcatccatttttcatgtttctgttgttactttttttctttcacactattgttcaacagacttcagtagctttttggtttattatcaataaagacttttctaatagtgttatagttggttgctattgcttacagaaatagttgatatgtgattattggtgattatttgaagatgttttagtgcattggtaatttattggagtagatccatctttgttccaattctcatattactgattttcttggaaccaatatgtctgttggaattattagaaaattagatgttggtctcttctatattcattcacatattcatccattgggaatttcagtaaaatggttctaaccagctttgaaacttaagccaatgcaatgttaatgtttttggattcaactcttcccagatgggtgatgaatacataaaagtcagtttcccctatattcaagaacttaaagttgtgtttaaggacaactttaattaagttcgttttccacatatgactatagtcaaagatagaaggtgaagaaatatgaaaattttagaaaagattacagaagaatatttttgttaagaaaggagaagaatattgggttttcgcaggtgagatggggaagtttcaggttattgcgtaatgcattaagagttcctatttccataatatgagtcagggcaataggctttcaaagcttctcttgactcagtggtgctatatttttaaattgtagattttttattctgctgaacctgtgtgtgtctgtttgcatactgaagatttttctagatttggtaagagttgcaaatgttacaggtgtaagtgaatgaacaaaaattatctgggcaaatttttagctcttcttataagggtggtttgtatattgtgaggcagattcatccacacccccaccccttatcctcccaccgtccgtccgtccatccatccatccatccatccatccatccatccacccatccatcttcccatccatcttcccctcctccctaaaagcaaagctcttcttgtgtgcatatattttagtcataccaattgccttttttagtttttatggttcagatacatgtgaagatcaatgtgaattaattgttatattccccactttcaaaattatcttccctactattcaaaatagtaagctgcacagtaagctgaccaaaggcagcttagtattttatagtcaatgtaataaaataaatagctttctaaaactcagagcaaaggaaacatagaaaatagatgagaccccagtgaaagttaataccatgacatcttctaagcttactgaacttgaacttttcatttcctggtagtcaaagcaaaaaagggaaatgtgatcagttacattatttttgcatataagaccaaagtgcattgctcaaaagaagcaaagttttctttgccaattagatttcaaagagatttctcctgtgagactgactatgtgaagggtgtcatcatgacaacacctcccaaaacttagtaatgcattttagatagctaattctcatgttactaagtggaagcagcggacataacaccaaagcacagtttaggaaaagcgaatctataaggatttagatttaggaaaagcaaatctataagaggtataagtaagtggctgtcacccttggctgtctgttagaaccagtgcagaattcccttagaatctatagggttggggaaggggaacaaggtttcggctccgtaggtgcctagtatacatctagggatgagaaccataggtacaagtgctgagcttattgatggtttgactcaattaaagagtacaaggaacagatagattgcatatttccttcaggtgccttgtagttctgtgaaagttttttgtgttcatttatttgttttctgttttctcataaatgggctttgaattaaaggtggtcttcagataattggaggttttattctctggtaagggcttagagtacacaatttccactgccaataaaagatccttaattttaaaattcattaatagattggtctgccttcattttatgaaaatttaggaagcaaacctagacttgtttgaatagatggcccctcatctctacagagatttctacagagattaggggccataagtcatatgataaatagaaagttctccagactggaactgatttatgataatgattcccagtctttgggcctcgggagttattgtagggattgctgttttctcaatcagtaggtatttgaagtacacatatttgaagagaacagtcatatgtgagtgagtgtgtgtgtgtgtatgtgtgtgttttaacctttaagcaataaagctagaactactagtctagaatagttttagaaattggcatttcctatttgacaatttataaaaattttagggatgtcttcctttagcaggtgtttagcactaaaatctttggagacatgtgccttcattccaaatctctgtagattttcttctctgtcagcaagcctaccattggcatatagaaagctccagtgagggtcctctggcatcatcctaggacttgtcactgagttgattggatgtgacagcatgtcagatttcagtggcaagaatggcatggaggtgagcagagggttgtcactgtagcttttctaggcagtcttctagcaatttaatttaggaagatttaacgtgtggagtctttgaagatgtattcattgatccaggaaaattttgagtgccgcacctctgcaggtttcggtgattttgttggtgcagaaaacttgttctcaacataaattcggaacactgaaagtaatccttctttggaggaggacgtatttgatttgcggaggccgaaggggactgtgataggtagctcttggtagctttagcaagccatgatggagggagagccttggacttgagtatctggagagcaggtgcagcgtcgtttttatttttgcatcctgtccaatgctgggcacagttgttggcagattgtaggcactggatacatccgctatagaactcaagaaggaaatgaggataaaagtgatacttgttcaaaggggacctagagaactgaccaacagtttttggagacgaaagggcatatcagctggagactgtaagcaaggtaggagggataggagcagcatattctcattagccagctctgaagaaggctgtaattgcctttgctccttagttcaagaactagcaagggcctgcaatgttactagtgcaaatgtaatcacacttttttaaattttattattattataccttaagttgtagggtacatgtgcacaacgtgcaggtttgttacatatgtatacatgcactatgttgatgtgctccacccattaacttgtcatttagcgttaggtatatctcctaatgctgtccctcccccttccctccaccccacattttgacttttaaaaggagattttaggtgactgtttgcctgtgtcttcacattgaatttatacagaccagcattagagagaattgctgaatccaaataacccaaatgaaaaattttaactagagtataaaatagagcctcactcctctttaacttaattcttcgagtattttaaacccacagagctctttgtaagcatatgaatgtgcacttatatatgtctactgaaataacattttatttcatttcctctttgttatttgtaaatagttggcaagcaaacatagactttgaaaatgccatacattaattttatttctttttttgcatgaatatgagaaaaggtgatgttaggattaattacaccagtttttttctgagcatataccatgtgttgcactgtgctaggcactagatggtgagtcttaattcccactctcaaaagaaactgtaaacaaaaaaagtctcccaaacttaaaacacaacatattacacaccatattacaaggctgtaatagatgtagaaataggattttataggtgtacaggcaagggactcctagagcgagctgagaggcagggagttccagggaaatgagccaggaaaaacagcagggccagctctagaggagggccttgcttgctttgtaatctgtagcacatcagtgagaaatcaagcttttaggatttgattctgtatgagtgtatcttgcttggttttgacctctctgggtaaccagaaatcagtctgagtatatagaaatggagctttcatattgaaggtacaagcttgtatcaagcttatattttgtaataaaaatatgtgtactatgtagagctcccaaggacctgatgcctgtctccagattaccctgaagcagtctctgttccgatccaaggtctctcgcttctacccagctgttctgggaggattgtctctagtcttttatcagataactttaagcccctgcagatacgtagtaataaataccaacttcctgcttgcagatccaagtgtttgcttctctcaaaaaatatatatgtaatctgtgtgtgatatttcaacatagtcattttcttgtagccacttctgagatgtattgacatgacttaaaacacttgaagcagtatttgagtgctgtgcatttggatgtgttctgaagcagcactgtctgtgtgatggaagcatgcaagagttgtttgaaaccctttgtgtcagggcactttctgtgtaccaatgttaaatcttcctctagcagtcacatagcttaaagcatggctgtttagtcactccctgcctaaagtccagggccaggctctgactggattggtggagagcatagcaagcttgtaaactgatgagggagggagtggcctctttgcattttaggctaactccagtaaggaagaggagggctgcagggaagagagcctgcaggccgagtggtatatgatatttttgctttacccattcttgtgtgactactttgaagtcattttgttatgcagacactttagcactgaaaacaccataaacataagcaatctcaaataatgtgcagaacagacttggcatcttgagcttccttattgttgaaaccctttacttagagtggcaaccaggacaggggtaagggagggaatgggagtggaaaccatctggaagacacactcacataagccctactatgttgaccatacacagtcctctcagagaaagctgtcagtcactctaggcctggagcctgctcagtctctgacggggcttctctctccatggtctgaatcatcgtcctctgatgtccttttgagtcactgattttctttttaaaattaagacatggatttggctaagtcatgatggaacttacttgttttctatttgaaagtctagaggaagggtttccacattttatctctgttacaaatttgcaaaccttgtttgaataggtacatcataaaccctgggtatggcaggatgttgagcctccggaccacattaggatcatgtcagtcaagactgcccccaaaatccttggaactgctgctaagacatctatctctctggtgcctaagcaaaataaatgcattatacttataatcagagtactcctttgaaccatagttttgggggacagaactgatacaattttgctttgagttctaacaaatttcttacagaaatgtttaaatgtatgaagttaaatctggctacaagggggacaagattaggaatggagaaggagtcatggtaatgaaaaaaactacattttttgacagcattgtatcaagatggcttgtgaaaatgtcttgcttagatatagaaatccccattaagaggttcctgaaagccaaaaatgagagactcctctaagacaatggcaagctggtgatggtaaggaaagggtgactttggaaggtattgggtggctggatgaaagaagaaaagcaaaattttaatcacaaaaacttttttctggtcttagtattcctctcatgctttggggaaaggttttgttgttgttttcaacaggcaacacggaccagatgacttgtcctcacatcactaaattattttctagttagatagtacatgatttctgtaaactgagctcctgagggtagggacagtatcctttgtatgcctctgcctgacactctcctgacacataaaatgtttattgaattaaggagtactgaattatcttaaaattattcccagaatgcttccttctttacagtatcatgatatgaatttagctattaacaaggaagactcttattattcttatttttattattttgccaattcacttttctttctgcacaataatatatgcaagctcagacatttcatggtatatacacagtggtctgtgtgtatgtatgtgcaagtatctgtctatattcaggcatctcattaatattggtagatttaattgaattttgcagccactccatgaaatggctacagatttggttttcctaaacatgaatagattgatgaccttgattctgtaaggcacacccacagattcggcccccacataccttttagtcttgtattgagcacctgctgcatttcagaccaagggtactttatagacatcctctgcacagccctgtgaggcttcaagcacaaaccaaagcttgaagaagttgatagccttttaccgctgcccattttctctcctttatgcattaaaaaaaaaaatcagacagtatgtacttggggttccagttcaaatggcatctctgcctattgccttctgtgataacctgagccagatctctgcacttccacagtatatggtgctattcaggtccccagcacagtgctttctagggcagatggggcactgggggctgtcagagttagaggagagtgttttacatttgactcttgtaaacatgaaagcttcacttaaccaagcagtctaactgtttgggatgtggatatgacgtactttagatcagaatgtgtttctaagttaaagaaaaagtggcatatgaggtgctgctttttaaggctttaaatcagtagggaacatctgtctgtaaaaaatcagcagaaaccattctttttaataagtgcaacattaaatttagcattaagttgtaaaggtgattagcaaggtctgtagagtaacttctcttgggataggtgtttccatgatttatttgcctgtaacaaagtcataaaaatcgatcatgaaattaattgaaataagccatttttgccaaaaagtttggaaacatttgtgttgggaatttgtttaaagtgagccagaaagtctattcttgtagaccatagctgtgtaattcttttaaaaagagttgggtattaaaaggtgattgttagaattcttttgttaaaagagatagtaaaaatgctttaagagcttattgaatttgaattaagatccccaattgcatatttgttcttttctccaaatcaatgtgtttggttaatttctggacaggggaaatagcataatttcctccctgctgtctgcttcctcccagcctctttccttgcatatgcgttggggttcagattttgcagctttccatgacatgcgtctctcagtaaaagtcatcttttccttttctgaatatctttaggagtttacagatatgtttattaccttctcctaccccctttttatgggggaacttagatgtctttcttgttagattttaagcttctagatgacagattctcttaatcatcatcctcagagccctcacagtgagtacaacgcctcttacctcatgagtatccatgaaatcctttgggagccctgctcttctggatgacctcacccctgcttccacatactcttccatttcagttattaagggattaaatcaaggcagtggaagccattcatgcttcattaatttgtgagataacagcctgcagtagcaagggcagataaagaagtagaattagcctttttgcttttgacctcttgccaaaccccaacaggatgctccgctatggggaactttcccccctgtggtggtttcatgcctagggcatttctaggtactgttttctttgaagcaagtttcagaaggaagtcctcagcagcacaagggattgctactaaattccaaagagcggcttccaggccctcaagacagatgtttccttctctctgcttttatatcttaagttcagtccttttccttcctgggataatttagtctctctaaatcccttatctgcttcctaatgtgtgtctccaatacctggcttctgcaatccacctttgaaaaagagtcactctttggcccagttcacattcttaccagtccaatagaaggaaaggtgcttattttgttgagtaactcttagcaagctggtcctgggcggggcagacttgaggatgtccattatgatttgataatggtcaggcctccaggctagaaaaaattttggggtgtccctaagcttctttgtcacaaggattacaaataagagttctaaaatcttgaaagaaaactaccccttgtgttttagattattttctgtaactaggatgtgaactcctgaaataatgagctttgcttatttattctaatgctgaagtaggagagtttcttgtccaattatgtgggtgttacaggaaaggggtcccaatccagaccccaagagagagggttcttggatcttgtgcaagaaagaatttggggtgagaccacagagtaaagtgacaaacaagtttattagagaatcagaggaacaaaagaatggctactctatagacagagaagccccaagggctgctggttagcttttttcgtggttatttcttgatcatgtgctaaacaaggggtggattattcttgagttttccaggaaaggggtgggcaagtcctggaactgagggttcctcccctttttaggccatgtagggtaacttccagatgttgccatagcatttgtagattgtcatggtgctggtgggagtagcttttagcatgctaatgcattataattagtgtgtaatgagcagtaaggaggaccagaggtctctttcattgccatcttggttttggtgagttttggctggcttttttttaaccacatactattttatcagcagggtctttatgacttgtatcttgtgctgacctcttatctcatccagtgactaagaatgcctgacctcttgggaatgcagcccaataggtcccagctttattttacccagtccctattcaagatggagttgctctgttttgaaggtgtcttacacagggatttctagtttttaaaacatcgtaacacatgtgaaccattttatatacacataacattcagatagtatgattttcttccttagtggttacatttgactgccaggattaaagtatatttttgagtgacccattttaaaaaatgtgaaacgtggtatatgttgaggctgacctaagtaatctatgaaatttcacaaaaatattgtgagatctgtgttttgaaaacaagtatgattctaaaggaagaagaaactaaaatgcatattcatcatatcttattttaaagcctgactttcaagctttatttgatggtttactgttgtcattctaaaacagatgtcatcttcaaatgacttatcttgatgatattatttttgttttgtagccagtaaaaacaatccttttccggttatgtagccaaaggaaagcaacatggccacttatgtttaggatataagaatgtaaatgaaattagaaaattacatgttgataaaacagtcttggaaaaaaaatgattgtagctcattttctaagataattttcacctgcattctgccatctgtcatgctatggcatagcatctttgttatattgggatggcaactagggacttctttgagattagatgtataaaaataaaagtgcagtgccttaaaaaaaataagttgttgttgtatggtatgtctttttctattttatttcctttcaacctatctatgattttatattttaaatgtcattcctgtaggcacatatagttgactcttgtttttatattcattcttacattctctgccttttaattgcagtattttgtccactgacatttaatgtaatattcgacatggttggatttaatttgtcattcaattatttatttctgtttcttccctcttttttttctttgttttttgtttccctattcttggcttcttttggattatttgaattttttattcgtataattccatttactttttagttattttggctatagttcttcatgggttgtcctagggattataatataccttaactttttagaatccatatagagttaacattgtcccactttatgtgaaatgtagaaaccttccaaccatttaggtatatttaccatccatctcctcccagtcccatctgttatgtttgttttcacattgttttctttttactgcatagtgcacactttgcccattgtcatttattttgaaaggcttttctaccttttcttgccctgaagcttggactatttaggaatgtttaccagtgttgtggctagcaggggtaactgtaatgtgtacataaattaaattaccatgcttatactggcataggacaagactgcagtgaagccttccaggataaaggtacaaataactataaagacttattttccctaaagttttaccttaagatgtgataagatgaatgtctggtggaagggcataacactaacttgacaatgatatcaaaatgtcaacttggggatattttccaattgggcaaatgtttctgaattaagaatatgagacaattatagatataaagatataaggaaggccaacgtagtgcctctccttaagaaaactcaaggtttccatgcaaaacacaccatacataattccctttctccttttccttctcttccatgtccttgtggaccacctcaatcctgattgggcttagcgtgaagttagaattggggaagcacatggaggttaggcatttttaaaaaacacttttttgggggttagtttagaaacacccagttttaggactaaaccagagctagtaaggaaaagaaatagtggagacttgtatatctcaattgtagatgggaattttgagactgagctattttgagaggtttgaattccaaaggagaatttcctggtgttatttgaaagtactctagggctcaagattaaatgaaaaggaataataccattttgagagcttttgaagaaaatgacttgaaataagaaggtagaaacagttatctaagttcaggtaagtttcctgagacaaatttagttctgttaaacactttggctaatggagaggtccaactaccagttctcagaatggattagattgtctttggagaatgatttctcaagcaactctatagggaagagctggagaggctgaaacatggggccatgtttgaaagaacataagctttggatgtatttcggtgtcacagacatcttttctgctttgcacttgaggtgaaacaaacctaggaaggaaatggcagggtagagaacatggagctttgggaaaagaagccctgccattgtgtctgatggccatgaaagcagaaccactctgacgaacactctgaacagaaataagatgggagaggaacaaaaataccagctagacaattgtgaacatgcaacccagcattccaccgtgacagaaaataacagatgagccccaaaccaaacttctaaaacctaaaagtgatagatacagctgtctggaaacatacttagtgctagggaaagtttggctctcaaagaacagccgtgtagctgatctggaaatgaaggggagatggcctttaaacatcgggctgaccctattcttagagctcaactagaggacagaagaagaggataaaaccatgcccttaatgtggtaggactaaaactgtgtttactcccttacgctatcgtcattatattataattaaccattcatttctctgtgtggtaaataacaatgctgacacggtcacaaaataatgtgaagcatatgggtcacaaccgtttttaactaaagacttctctaaagatttatttaggttccttaattacagagtggcttggaagactggcatgtggtttcagtttatagttataaatgttggagctgatgatgggtacgtgctcttattgccagagagggagaggaacaagattgggagggggtttgtgttctttggggccctcccttttgcccccaccccttgtttttttaaagaaattgaagatctgtgtttataagaaataagtctgatgacatttatactgtccttgagatgggtatgccagtagttacaagcaaatttttccagtgcttaagtactttaattggtaaattttcacgtcactttgaactcagtggctctctagaatcctgaaagaataaatcccttttagcctttgtcttctattaaaattatactctctgttagatgaatgagaccctgtctttgaggacagcagttaagtatttcagcctggatagagaagaaaaaaataagtattcaacttaggttctttgagttaaaatgaactcacaacagggtgatttggtgatcttccaaagccttgtgtttgtatatatgtgtgtgtgtgtgtgtgtgtgtgtgtgtgtgtgtgtgtgtgtgtgcgcgcgccatatatgttactcatttttgaagtaattttgcattattttggaaccagtggtaaatataatgcaaagttgtagccctaggagcatgggaaaaaggtctgtattcaacaatacatgaagaattcagtgagtacgtattatatattggaaaacttcttttgtatttactgtaatgtgttttcctgcatttcttgccaatgatgataatgaaagtggcatctcaaaatattatctgaacattggaggagcagaaggggaggaaggctcataaaaaaatctaagcaatgctttcctttcctacatgaaggtcatagaagaaatgaatttcccattgtttatcattcttcatggagctcactccagtagggactttgccactgcttcgagagcatccactcattcatccatcccttcatttatgacttggtattggttacatttcatgtttatgtctctgtggcataaacatggcataaagattaattagaaaggctctgccctagaggagtttgtattctggtagggaataagaaggtgtgtacataactaattataacacacaaagattttctgacatttattcagggctttataaatttcaaagtgcttgtatgcacttttatttgatcttctaaagtatgtggctacattctccatgttggagatgaagacactgaagttcagccatggtaatgacttgcttgaagtcaagtaggtgttgagatacatctatagggcccagggaattgcatctgagatgttttctgcctctgtgttcattgttttccactatccccattatgcaatggtgcacagactggggaatcagaatgtgagagaaggctaaggccacaagcagctgtgaagcttgagcaaggctttggttgtgtagagaatggttgaaaggcctttgagagacagagatcagtgcacattgttcaaaggaacaagctagaacaagctgttattcaaaaaagaccctggtgtcaggatctttttattactttttttctgtctgtcgttttattcatacattcattcaacaaatgcacttagagtatacagtacttattatatgcaaggcagcagactcactgatatgaaggttacaaaataagactaggggtggctatccttgaggatctcacagtagttcagctggaaggtaagatatgctggcaaataattgtaggagaacatgatgagagagggaagaatgtgattcacagtatttctgggttcaagttatgactcttctgagaatgggatcatgggcttctcatgtcatctcttaagaccatgtttctttaaggaggctagcatttaatttgcaggtctgtgttgaagattaagtccaattgtgaatcctaggacactttactgggctcctggcacatcaaaggtgttcagtaaattgtcattatttatggttccgtatgcctttggaagaaaagccaaagtccttgactggtgtgaacagctctctgtgatctacttggccaaatatacactcttcctgtatcccagtctttcaccagtctcctggctgcagactggttgctctctgcacccttgtcaccctgtggtctatgcaaaatgcaaaggtgctttatcccagtggtcagtcgcaggcgttagctctggccctgctgtgtcacactggcagtggacctcagcaagttatgcctttgctttgtgctggtcttgttgtgagatttaaaatgactaaacgtaaagagcttggaggcagttctggtacatggtaaattggatattattaattccaattactgtcttatccatcctgcactgaagcttcctatcagctcttttgtttttcatttggaacctgcctatctctctccgcagctcatctcttatcctctcttcattatgctttgctttgccttccagctacatcgaactgcacataatccttcaccccacctccatgatgttttggcctttatttttgtctaaaagacatttgtcttgctcattcattctttaggactgagttttccacctcttgagtttctctgagtccattctccacccctttgaggtttgtcttgttctgccatgttttgcacatacctttatcattgggcttaatgtattggctccattttctctttctctttctctcctccttttgacggagaactcctgaaagaaggggtcaagcattaattgtctctacactccagctttttcttgacacatagtagactctcaacaaatacttgttaataaatgaagtgaggactttacctattttaaatacattgtcttattgtcagaatcattttttcaattagctagaaggggcaaaatttactttagtaaattttgaagtggggaagagcaacaggaccactgctctggccttacttgatagaggccctttgtcatcctaaggcagggttagaattttgggaggcttgggctggacaaaaaccctggcaaacccaattttgcctctgatggatcttagagttgcagtcatttgtttgtaaaggcagtagttctgtatttaagttattgtagtaacatcagctatttggtatttgataatatttttcaaatgtttgaaaagatttttttccctcatattgaaacttcagtgtatggtcctgaaaaatctcaacgttatccaattttagacatgtggtgtaacattttctccttgtttgtctgagttacctggattttagtttaacaacccataaatgtagcttgctgggtttataaataaataaattatttatataaataatttcatataaattttatataaatttattaaataaatttatataaattatttatttatataaatagtaaatattatataaaaaataaagcatatcattagagtacaataaaacagtactattttggttaatagagaatacatggaagaaggtaacgtgtcacaatggatgggtttatttatttatggattttaagaattcaaaggaaataaaaggtgatagcttgctttccaaaagcatatcacagtggccctttaaggagcttgtagttccatctgataaacacataataatgatctgaagtctaaggaatttttttccattatcccctgcagctttgccctttcggatgaagcatacagatccctacgagatcaagataaggaccaatgtattctcattactggggaaagtggagcaggaaaaacaggtaaggctcctaccaagcaactctgcagaaggtaaatgctgcacagaatgacaacagcaaagaggaccagtagggcctccttagcaagatctgtcgcagggccactgtgagggtgcttctgcaggaggatactggttaggaacacagaatgttctctggactccccagagaaacaagatgcctatccaaggggattccaaccaatatgaagtctagtgccggattctagacctttttagcgtagtctctggatggtgcaagatctttttacttttctcccaagacattaaacctgtgtgctgttacagattcaaactgcttccccaagaatgccaatttatttaggttttaagagggtacaaacacactctacctttgctaaaaagtgagggaagataccagaaaaatgctaacattttactcaagagttttcctctgaagcctgaagaattgagatttttatatgtattttttagacctggcaagcttcgcataaaaaaaccctccaaatggaagggttatgcttttttccccttgtgcttttaataaatgcaattcatatgattggtggtcttgagtgagaaaataactttacagatggtgcccagctacctggaaaagattcagaagagccacattctctgaattcaaccttagaaacgtttaaagctgctgttatcagtgggttttttttgatggaactgatgagtctgtggaggaggaagatggtgagggagatggtattttcgtaaagtttcatctgtaaaatgcttttgttttatagataagaatatgataattggtcaattattttagtattcaaaggtggaattttaaatgtttctattctacatggctggttagttgtaacatttacacattttgagttcccattgatcaagagaagaaaatctgccataggtgttgagtcaactgactgaatccattttattcacaagctcttagaaatatttgtgccttgaaaggctcactatctacatcgaaatggttttccttctacacctactctttactccacttgccttaggcgtaactcctccctgcaccccatgcagctgaagaaagagtggttagatgaatgtgtccagccccctttcttgagctctttggagacaccgagcaccattgttttgcagggctagccaagttctaggctctaggtggtcagaaatgaagggaaaaggactggcatgtaagagccttaggtaacagaaaacatggtgtcatattgttgaagggattttagttataaaccacctggtgtaggctcctccacatgggacagccaaactccttttgaagtgatgaagtctcaccactttgaatggcacccccctggatttgttgtacaggttcagctaacaaaattcttccttacctagagttcaattctgcctctacctatttgtcttcagtctgctacctggaactttaccatatttgtcttccttctcctctacaggacaatcacttagttatttgaagtcaacattttatctttctagggctaaaaatcccttttcttcaaattttctcattttatacacattgatttaattcattcatccagaaaaaaaattattgaataccaacttagtgaaaggtactatactagggactgtccttgcccttatcacatttcgtttagtaggggagataaacaatagctctttacatagacatatatgcacgtacctatacatccaaattacatgcaaaacataagtggagtgaaggaaaatcacatggtgcttatgagagcacattacaggaagaattggatcttacaaatctctcattatcttggtcctgttgttctggaaacatcctaatttgtcaatatgcttcatgaaattgcataccaaaaaataaacagaatacttgagatttggtcctggttgtagtggaactcttatcctttttctttttgagacagagtctcgctcttatagccctggctggagtgcaatggcgcgatcttggctcactgcaacctccaccctctgggttcaagtgattctcctggctcagcctcccaagtagctgggattacaggtgcccaccaccacgcccggctaatttttgtatttttagtagagatggggtttcaccatgttggccaggctggtcttgagctcctgacctcaggtgatccacccaccttggcctcccaaagtgctgggattacaggcgcgagccaccatgcctggcctattatccctcttaatgtggactctgagcttctattaatataaagcatgtattgactcatactggtctttaaaccaagtaagatattataggatttttttttttttcacagtaacttccattaggtcagatctgctcaatcaactattgatgaacaaaattattttaaacttacatgcagaatattgtatttatttttattaattttggtccattgttacaacctcttgagaagctgacaaatcctgatgctttcccttcccttaggattgctgtcattttgctgggtgataatgatactagctaacccacgttcagcacttatcacgtgctgggcggtgtgcttatttacatgtatgagataagtatttttgttatttcagtttttatgatgggaaaataggaacacggaaacattaagcaatttgccaaaacttatacagtgaataagtggcagagctgggattttgaatgcaggtagtgtagttatagagtccctgcttttatccactgtactaagctgcatctctgtaccttgaacatggtacagagtagttcttgaacatgattctttccgagtgccacactactttgcccatgttggtaagtctccttcaactagcctcccatgtcttcttaagggagggattttgtattatgtttctactacctaatttaatggctgccatacagtaggtagtcagtacatatttaaataattgaatgaacatcatgtactaatccaaggagccagcctcctgtctttatttaagtaattgacaaaaacactgaataggactgggccaaagactgatccatatgaaaattgccaggtctcatttaaaatatgtctatcttactaaaaattagttgatttgcttagttctgggtatctttatctttctccatttttttccttaggcagtctcaactattttccagtaacgttaatgtgttctacatttacactgctagtgaaaatacctcttggctgatctcccagctatgtatttactgcctgtctgacatctctacttggggtctaacatgcatctcagactaagcatgtacaaaatggaactcttgatttctctctttaccctcttataaccaatctttctgatctcaataaatgagaccactagtcaacctagttatcacactagaaatgtttgttatccttgatttcttcctttcctgtatttcccatatcaaatccctttcctaattttgtcagttctggctctagaatatatctcataccaggctctctcttccttttctttttgtccacatggagactcacaagccaccacccattatctctcatgaggattatttgtagcagtgtctaatgggtttctctcctttctctcttgattacccctaattccattttacagaccccagtctttgcttgttcaaatctctctctctctctttatctctctctgtctctgcctctgtctctgtctcttaacctgtgggaaactttacaggacatgggcatcttgagaaaatgtttttaccccttccatgtcactaaccagttctttcaggtgaaacagaatttaattcttagaagcagtacagcttcttgtttgtctctaggttgacaaatgaaaatggtggcaaggcaagttagaaactctgttccttgctgaaggcatctgtactgatgctgtatctacgcccacccctccccccatcctatttgactctatctacaagcacacatattcacttcatattgcttcatttttattttcacttggaagaagaaaagaaaatattcctaagcctctttcattcttacattctttagctttttagtcagccttctttgtgactaacggtttttttttttttaggatattctaattgtatcaattcgttcctaaatgagtcatcagaagtgggttgcggtcattgttttgatgggtcttggccagttcttcatctcctctggaacatgtgttctgagaagacagcacgtccactaattagctatgtcagtatgtgacatccgccttctcagagagttcttaacactactacttcctcctggagccagattccatctcctgatgggctcatgtatcttccttactgaaaaactgagtggaggttgctagtgctgtttcagaggattggcatccatttttcttaggaaaaaaaataactaccaccctatttctctggtagaactctagtagtaaaatggagttcattcttcttttttatagttttctcttgttatttttctgcttgacaatttgttctattggtttcagtgcccaaatcaccacttgaaatcctcttctccttgtcatcttccctggatttagtccttctggggatcctgttgccctttatcagaagctggaaaatggacagcgcttcccagggcttgtcaccctttcctctggtagtgccattgtgtttacagcacatagaattaggtgctgcttcagggaggaggctggaggagggtccaacagagacgctagagcattgcttctcaaatctgtggtgaagcaccagttccaaatctcatgttcatcattactagaaaaatgaaataatagacaaaatagagcatttaaaccttaattttttcttttagtttcaacaggcaaaacaagcaaccaaattagtacagaagcttttaaaagcctacttgcatgtgtagatcacttaatagtctgtggattgaccaacttggagtcgtgctggtccttggaccatacttcgagtaacactgcctagaagtcactcaaagcatttgtgttgtttttgagctactgtgcttcttggaccctgtgatgaactatcgtcttgggtgcttcagctgtctgttatcactaagacgcctggagccgggaggtggataccgctcctgagagtggttcattttgaatacccacttagctacatgcttggtagcacctagcccttgagtccttttcacttatggaacccaacagcttctcctacctctcagtccactgtagacatacagtggtttgctgacttactctattttctttcttttttaaagcagtggtacaaaaactgcttaatattttatgacggttttaattgtctttagtctatcaaattgagtaaagccaagaatattgtgtgttgtttaaagtctctgttttatggagattacttacaggaaaataaaatgatggaagataatatagaaatttcagtatatagttgtacaaggaatttggagtgggggtttcatctcagttttgagcagaagagggatgccaggccattttgaaatgtcatatcatcttatgcactaaaattgtttttgtgtacatgtgttcattaaaaattttgatttagtaaataaatgaaagaagatgattaacatttattgaaggcctggaatgtgctgtgtgcttgacatataatatctcctttcaataaaagtctttacttaatagtttgtatagaaccaccatgtagtattagagggcttattttataagaagtaattaacttaactgggtcataaaccctccttggcagatgatgatgttattggtcttaaacattggagacactcttaagctgcggagttatgtaacatgggcacttagggagaggcgtgaactcttttgagtcctttggggtgctatttaattcattactgctgtgctaaatgaaaaattcatcagacctcataaaagtgcccatgtatttttaggcattgaactcacaactcactcccatgaatacagatggtttgtggagaacctttcaagcactgatgggggcaggggggcagaatatgagggaaccatcaaaactacatttttccaaggacatcagagtaaatctctgggcctgagaagatgatcccaacgttaggaaacataattatttggtttctaattttacagttacatcagtttctaggaactcttcagccatctgctagaagagttatgaagcctgccttgctcattaagacctttggttctaaaccccaaatgaccttatgtatctgcagtggttctccaactggacagtgacagagatgccactgacttactgtagcctaaacattggcgagcatttcacagtgttgaaaatacccacactgaagcagaatagataagtgaagtcaaggccaaaatgtagtgagcttttgttttgtttttcccctgtgtgagaaagacccctctccatccgtgtgtttaatataaattatcagagattttgtggccctctttcagaagaggatgacatacaggcttatttcaataaaaacatcaccagttgtgacttcccttgtaacaaaggctgcgtctctcattgcagggcccatgcatttagtactctggaacacttcactgctgcctgttagatccatttggatgtgcgggagctgggttattttgcagcacagtagactccagactgctaaaaggtggtttctccaagctgtagagtgcttgttttgttgaacacaaacatggcctcattgatttaggcattcactctttagccctaaactctggtctagggctctgaaccaccagacctacaaaagctcaattcctagaaaaactttggtgtcttaactagagagatagagaggtaaagaaggagataaataaatgtgtacgaataaatgtatggccctctctatatgccatatgacctgtagatcaatatgcgacatacatgatattgcctatatctatgaatttatccatagagacctgttactcctggataaatttattagaagctctgtgaaaaaagtgcacaataatccttgcctattctcaagccttttttcccccaatgcagtgattgaatccatgtggagcctgctccattaacatagataggtttaggtatcttaggcatgagattcccatccttttgtcatcatgacaattgtctttccttgaattgttttcccttcctcattcaccttccgctacttcacaatgctttatttcattaaaaagattattatatatgaatttatataattctatgttgtgtgataattacatgataatacatattattcacagtacagtgcaaggtgtcagagaatacagaattcaattagttattcttacccttacaggactttaaaatcctcacacatttaaactgtcatctgtacttcctttccattgtttgtagaaattaattctgatctagatattctgatccagaagtattttgtaacaggccctttgtccattagtgaggaatatgtgttaaccctaaatgttctgccattttctgatgagaagagattttgaccccagaggcttcatatattttgttagtccagctgttgatgaattttaagattcaagttacattcaaacatatatatatatatgtacgtaagtttacatatataaagtatctatgagttagagaaagtgatgaaccaagaattgattctaaacaatgctgttacattttgtctattttaaatgacaatattcttatatttaacagtcaacataattcaaaaaccagactttgaaatatggtggatgatactccatttttgattctcctcagaaatgcagtttttcattatagaggttattatgtaaaggtttgatttgtataagtatataaatatttgaatacagatccaaatttatttgaactttagcaccaaagagtcaaaaggaaatgaagcacaaagtctcatgaggtaactattatttccagtttccagcgtggtgaaatattatgaaaacagttccttaaagtatgttggaccttgtaattcatccttactggtttattaatttctctaaagtagtgcctgtgtaatgaagtacttgagttaaaggtcaagtatatgtcaggaaaaaaaaaattataagagttgtctcttttaaatagtgtgatttttttttttggagaaaatactaataccagcttccaaaaatgacttattaagatgagcccagtagtagaattcttgaaaatagttaagaatctgaagatatttttaacaacttggaaataaattattaaaacagcttgaactttattctcaaactatattttaaaattttatttgaattgcttaaataggttttaaagttaataaagtgattcttaatttcagtttaaatgaatccatctttatatgccaggagatattatgggtttatatatactttaacagccaagtgatgtaagcctgacccaaattccaggagatctgctcctggtgccattttcaaacacatttgaccctgagagaacttgatcccatcttgttctggccattaaaaaggtctctgagaggtcaaatcaattctagtagccaccaaaagattctcattcttggttgattttccccccaccaccaccctgctaaagcagttgtcctctaagttcatcctggaccagaacaggttttcagaggactcaatgtagccgtgaatctgaattttgaggttttgaagtttggccacagtaaggtccataattaccagaataacaaaagagcctgacctaaactttatatatttttggtcagtttacctaaaagaaaacttaccttttcatctaaaatgtgtgagtgtgtatttgtgtgtgtgtgcattagtatgtttgtatatttgccactgtctaagacagttattttgctgataaatgttttcagtctcctagtattacgatggatagataggccagaaatttatgtcaagaaagaaacatatacataatatatgtgagagttcaggtggggatggggaacaaagaatgccactgagaaagcagaaacatgagaaagcaggcctggaggggattgcttccaaggccagactacagagttggatgcctgggtgattgaagagagctgccccagtgctggagactagatagcaccggatgttaggaacctgctaggagggcagcctcacctgaattgaaattgaaaggcagagagcctagaaagtatcctgaagtgagcagggaagagctataccttggactagagggtagagggcaatgtggcccccaggagtgaaatgaaatataatagtatataaagtctttgtctgtaagtgatggctcaggacagcctgaatggtgtaacaggattatctatgtataattcaccagcttttttctagataaaccatgagaataatggaaaatgtagttgaggaactttaaatgttggtggttgtgttatgtggacagtaagtgccctgtaaaagaacggtattgcaaaggtggaaagatggttgtttctcagttacagtctttaaagggagacagcagaaatcaaccacacagatgaccagacaacctatttggattccttttcattacccagaaagcaaattggagagagttacctccaaccattgaagaagcacctaatgtcccaccatagttctgtgctccatgagattgtttacttcccccttaatgtatttgccagtactccagaaacagacatcttaggacttgagagctttatgtgacctgcatagattcttggtcttcagtggctcctattggttgatgcttttaggttgcgcaaaagccctcaggaatacgttgggcagtgtgctcaaagtggcattccaatttttcacgtattattttcccaatggtgggagatgggactggaatccacctgcaggtctcctgtgagacagttaagattgcctcattatacctgtaggcagagagaccctccaacttggaggaggctcacctgcccactgacagtggcagtagagcaaagacttgagacaaagcaggatgtggagagactggtttccttaccttaactacccagaccagggaatatgttttcttctgccaacataaaatagtcaagcattttctgggtcccagttacggaacattagaacaactaattaggacagcccaatcaatggaaaacagattccatagaaaataaattagggaaacagcattctagatccttttttagagttcagcagtgcacgcgatcatattaaaagctctgagaagccttttgataatgaaagtggtttcactgcatctgactcactgtagctccacatccactttggaccttattttccttaaatatctattaacatttcttgaaacttagtgttaaaagaatcagaagctaggaggcagatgccgagagaggggacacggactgatagggaagggataaaaccaccaaagacatgtttagtccccagtttgagctaaaaaatttttaggtggttttatcctttgcctcatgtggcctattctttagcagctttagtaacggggttactagtgaagcctattaagactaccatgtctggaaaaggctgcgtttttttgttattaaatccttacattggctgcttagtttttgaattaagttgaagaataatgaatttggtctaattatgagcaaaccagttttttggtttttggtgtttttttttttgagacagagtcttgctctgttgccaaggctggagtgcagtggtgcgatctcagctcactgcaacctccacctcccgggttcaagcactccttctgcctcagcctcccaagtagttgggactacaggcacgtgccaccatgcccggcttatttttgtattttagaagagacagggtttcaccatatcagccaggctggtctcaacctcgtgacctcatgatccgcccacctcagcctcccaaagttgctgggattacaggcgggagccactgtgcctggccgagcaaacgacttggaacttgtgatttggaacatatctttgaagaagagcagtcttttaaactttaaaaatacgtttggtaaagatacccaggttatcaagttatttgtggcttatcagtatataatataataattatatataaatgattgctttaagaagataattctgatattttgttggtcatgttactaagcagtttttttaacagcccagtgataaactttaagcacagtttttattatgtctgaattaatgacatgtcactgaatagaaagcacaaatattttagaaaggtatccaaaacattatttactcctctaggaataaagacatttgaaaatgccgttagtgggtcttctcccacatttcctcctccccaaaaagattttttaaatttctgtgttattgattaatatggcttattttcatccacagaggccagtaagcttgtcatgtcctatgtggcagctgtttgtggaaaaggagcagaagttaatcaagttaaagaacagcttttacagtccaacccggtcctggaaggtaggatgtgttatgttcattaagtcggtgtgactcaaacagtagattgagttatgtgggtgctttgagtacctggtctgctgggaggtattctgggagggaagaggaaggaagagattcaggccaagacctgctgagcaaataagccgtgttctagaacctcttggcctaagtgtttagcagaatagtttactaatgtaaaatgggcttcctcacttaacagtcacttttccccactcaatttttatttgaattctttaaattttgattaaaaataatcaactgatcatttgcatatgatggtgcagtgctgttttattattcaggataacacctgtggctgattatttttgttgttagagaaatgagggctcaccccgagaaacacttaaggactcattttttccagagtcatagaaagcctaaacctgactggagagtgctcaaattctctatttagttctctgtcttagcttgggctgccataacaaagtacacagactaggtggcttcaacaacagaaacttattttctcaaacctctagaggctagaagttcaagatcaagctgttgtccaggtagattttattctgaggcctcttttcttggcttgtaggtggctgccatcttgctgtatgctcacttgaccttttcactgtgcttgagtggggagaggtgagagcaagctctctggaatctcttctcataagaccaccagttccatcttgagggcctcacccgtcatgaccacatctcaccttgattccttcccacaagccccacctcctaatactagctttttgagggttagggcttcaacatatgaattttgcagggagataagcattcagcccataacatcatcagaaaacaaaaccagaaatgagtttccttaatgccatggagaatggcatacaacatcagtatgaactaccttggcattggaaacagtatatcaaagtctttccctactgatggcaagctattaaactgctttatggctgggcacagtggctcacacctgtaatcccagctctttgggaggccaaggcgggtggatcacttgaggccaggagttcgagaccagccttgccaacgtgatgaaaccccttctctactaaaaatacaaaaattagctgggcgtggtggcacatgcctgtaatcccagctacttgggaggttgaaacatgagaatcgcttgagtctgggaggtggagtttgcagtgagccaaggtcacaccactgcactccagcctgggcaacagaggaagactctgtctcaaacaaacaaagaaaaaaaacttgttttatattgtaagcgacagagggagactctgtctcaaaaaaaaaaatgctttatattgtaagcatgtctttactgtcacttaacatatttgttatggtggagtaaggtttctcagcctcagcagtgttggactgcttacatgttgctgtggaagggtgtcctgtgcattgtaggatggcctgtcctgtgcatctctgacctctgttagctgccagttgcacccctgcccctagttgttacagttgaaagtatctccagacattgtcagatgtcccctagggagtcagaaccacccttgattagaatctctaggctagataggtagtttggtggaaacttttggttcaagtcatagaagtaaagtcatggaaggatgagattcaacacggattaaagcagaactgctttggggtagttttttcccagtatgaagggttaaaaccctgccctgttgtcgtttgtactcaggctcagcctctcctgccctttcagagaggctcccgaacactgagtattcactgtgaccccaagacacacttcccatgcttcagtttcaccattacaaggacacaccatgcatctgtatccccagttagtagcataagagagaaatgaaggcaaatcatctattatgctgtttttgatctttcctccattgcaatatcttaataacgaagctattatggaaagcgatatctctcaattttattgttccaatatttgactttttgtttattgtcttttgcttttaagttggggtgctatacatttgctgtatttctgcatatgtttattttaagagtgctgtgatgtaaaggagaaatgctgaggaatgctgtagcctgcatctgtgactggaatctggctctttattcagtggtatttggaactaggctccagtgcaggaaatagaagaaatgtctactgtgggcatgcattatcttttatgggaatgctttactttttagctggagctgctactgtaaatgaacatttagaacaatgaactttaaaaaaaccaattgaggaatgtgtctcaagtgttctataatggaacacttgctttttattctgtggctcacaataaaaggctttagtgtttagggttgtgtttagtaatgtgcaactcagatttgtttgatgaaaagatggtttatggcttgcaaatagcaccctgaataaagtttctttgaagcaattccttcacttgcccctgaccttcaagccacaataaactgtcctttatgcatcaacatctctagtcggacttggggctgtgcaagttagctaacttggcagccctgcatgttcacacccaccacaaaagactagcctgtgaaaacacaagaaatgtcatcgtcttcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctctaaggcaaagaactttgcctgtgttgactttgtaaatgttgtcttaaccaagcttgggcaactatctttttaagaatcaaaaacacagccgggcgtggtggctcacgcctgtaatcccagcactttgggaggccgaggggggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccgctgcactccagcctgggcgacagagcgagactccgtctcaaaaaaaaaaaaaaaaaaaaaagaatcaaaaacacgaaaaagccactccacacaaaatataatgcatcaagtgtggctgctgaattaccggagttaacataggtaagcacacaccctctctccttgatcagagacttctgactgctttcaaaagtcagaccagattttagcccgtagttctcatttgaacactcagtagtctaatctgctccctgtttaatttgaagaagttatggagacctctagagatttgatgcctagcctctgattccagaagtttatttctgttcaccacattattcattctagctgccgtgtggcccctggatcccagtaacagactgggcaggtgggaggcttggtagaaacggaggatctcatgcctcttcccagacccattgaacctgagtctgcactttatcctcatgtagttagtttgcacattaaagtttgaaatggtaaagatgggcggggtggggcttccagagtgtcaaacagggatcgcctctacttatacaacttatgtttaggctacttaatcttctactaccatggcccaggttaacttgctcctatcttatgcacaggcttggtgaaacaatccttttaccctatgactccgtgctgttccctgtgttaaacaagagcactgtgtgtctggaccagcgtcaaccatggggttcttaaacgctctcatttaaaagggagtcctgtgagggatttgtctccaggaaacagctaagattggaacatttgtattttgcattatgggccaaattgtttttctttgttgtctggaaagtttcacctaggtctgatgtgcataaactgatgaaaccatgtagcacttgtagcctattggaaatgactgttgtttccaaatctcttattcttcctgtattccagagctatataattaataatatttaaatagctttattttaaaattaattaaacaatttaaaggttcacatgccattccccatgatctggaaacttcaagttccataaagcctttgataataagtaatctctgaaataaccttattcagtgatgataatcctagaagagcatgaagctttgcttcctggtcactcaattgactactctctagaagtgttaaaaggtgttgaattaggtaagattaagtttacagtaatacttgaaaaaattccatgagtcataggaatgattctctttttctatgaacttgtaagacatggaagctttagcaacttactaagacttctgttaagtatatttctatggaagttttggacagaaatatcattgctacaagttgtattttccagaaatcatagatttcaaatactgtatttgctttatctttctgcttgagattattattatttttttaaccatacatctgtttctttcctactagcttttggaaatgccaaaactgtaaggaatgacaactcctctagatttgtaagtatttgtataagcataagtgttaacactaatatttagctcatgtatgtttaaacaaccagtagatgtttaatatttcttaatacacacatttttaaaataagaggaacatcatctctattgaaacacaaagttctataaggactcttgatttctggaattttccttttgaattctttttggagtaacaagcaatttttatcatgttttcttgacatcttctatcataaaatcccataagcaatttaaatgaggctatttagagtaacactttgcttatctgagtttggtatttagaaatcaagaatcagaaattaagagaaagataaactgggtctcaagtttagggttagggtgcaccgtaacccttgtcccttattcagtgggtccagaaaggatgggatgtattttaaaattaatagaggtaaagtccataggcttggcaacaaaagcaagcatgtggggtgagcgtggggctgtagagtagaactgaataataaaaaccaaatctatttggtgttttgagcttgattgagttggaaaatgctacttctccctacagggtccatctttccagcctcatcccccactactccctggcctgtgccttgcatgttgacgcagtgggctcctccaggcgggccatgctcttgggtgcctctaccctttacagagacacagctgcctggatgcagctgcaggaaatattgagtctgatggtggtgttttgaaattgatgtatacatttttataataaaagatcatttgtttaatgaaccgtcttctcacataccttactgattgccaccagggacaattttgatgatcttttatgcctccttatgtgagacccttcctgacctttctccaccttcttcttttagatcccgtttggctctttcctccttaaggttattttgtgcttaaggcaggacagtgacttcaagggagatagttttgatagtttagaaaatggcaggctaaataaggttcctaattccaaggctgtgaattttttccatcagattagccccttaagttgttataactgatttgatctgtgccttttcctgttgtggtaacatggctaatctcattacataaatagaattagaagtgaagtgtgggcgatagaagtaattctaatgaccaagcttctttatgtgatagagattttatttttgctgtttgcaaattacatacacacacagtatttaatatttgcaaatatatttagtctatagatcacaaaaatgtaaaaacccatattgcttaaaaggctattactactcagtgatatttgaaatctagtgaaaggcttggcaggtgatttggcttattaagtaacttcagagaaatcctattataacacgggtattaggatatgagattaatacctgattatgggctaaatcatttcatgcccagtttttagcagtttctctgctttgtggtctgtgacttgactagtaatatacccatgttttaattttataggaggactctactgtatttaaagttactactgtacctaacagtggtttatgtacttgtactccggggaaattgcaatgtcttcgacttgcaaaccagtctgtgttggtctggttaacctggaatgaattccttgacctcttcactgagtagtctgatagaccctgctatgttgtagttaatgcttgctcatcgtagctcacattttgaaccagtattcccatggagatgcctcacagtgtccgctccccaccacagcagctgtagtttgacatattgagctacgagttatttctgagtggactagtgacatgatcagaacccagcttttggcgagtaatcaggaagtggcttagtgggaatagtgtcattccactatcaactgaattctcagggctggccactcattggtttatccctggttgtcttccttttccattctctccagtgtttattctactctcctcaaacatcctatttttttactctcagctcatgatgttacgcctacttcacagaaatcaccatcatcatcatacaggccttcaaactgagttaatcctgcttcctggtgcctgacctatatgtatgtctatgtacactccttttacctaggctctagattctgtcgcctcctgtggccagggaccaccttctgtcaaaaggatcccctcttacatggtcaacctctgactcctttgacagagtaaccattctttccctcctttgtagctgcttcacctccttggtcccccaccttcttggaggtcctccctgtacactgagtggcctgggccacatgactggacttttttttttcctctctcatctcctgcatccaacctgggcctgttcctgtgactctccgggtagctctcaattctgtttactttttctctttgactacttctacttaaagccaccaacatttctccactaatcactgtagccacctcctgtcagctacatcttctcttgcttctttcctgttcattccatgctagccagggaaatcttgtaaataggcaggtttgatcatggcatccttgtttaggagcctttaaggacatggctttggtgtgacgagaatatctcaaagtaatcatgtgctccaacttccctctccagccttgtttcccactcatcctcacggttgccaattcttatgcctactccttcctggtctcccacctccttgcccacctgacttctgctgatactttgcaattaagatggggcagatttcctactctccctttgttcccgcttctttggcatagcaccaggacccactgtaggacatatcctcctagactggaatatccagttaacctgtctcaattcccccgctagacagtaagctccttgaaggcaggagccatgccatgctttcgcttgtgcctacttcagctttaaggaaatggttgagggacatatccttatgaataagtgcagacctaaaagggtagaggacccatgatgatgaaaaaagagaaggtgcaggagcatgcataagccgataaaaaggcacaaattgcattgttgactgagttccatgtgattgtatttcttctcccttaccctcattttgaaaattaatgagttaaagtaattcttaggacatgaaacaaaactaaagactttacttattagatcaacacacacttttccaaacaagaaacagctgtcacagttactctgttatacttgttactctttaggcaattatagaccagttcttttaacaatcagaatattaaactctatgtgtgtttctgtgtgtttaagatactatctataaagtgtaaaatgaacctgcgttatatattgctattataatctgggtgaaaagccaaaaacagtaataatgaccagtgtgattctgacctgttcataacacataatcttgtatttgatttgagtagatataaaaacagatctctgaacgtttcaattcatttactgatatgtttcaagttcctagcaatggcttaaaacatattctgccaataaaaaaagactatcttcccaaccagtctgtatacacagacaacttatttttcttctgtttttatttttgaattgagtacatatcctccagaagtttgaaaaataatcttaaatggaaaaatcacatgatggctgagaagatttgttcctaaattagcagtgggttatattagctttgaactaatggggtatttagtatgaattatttatggaggcatgttgttttgcatcgtggttatataaactgtgtctttcttagttacatttaaacaaatgtataaaaataagggcttagtctgctgttctctaagaagtacactgagttaacattttgagatgaactagaaaactcacaaaatctttctttggcagggcaaatatatggatattgaatttgactttaaaggcgatccactaggaggagtaataagtaactgtgagtatttttcttcagtccttgtaaagaagttcagaatactaaaacatatatttatagtagaatagtttagatacttgtgtctttgaggcataagaatatgtttccttgctttatatttagactttaagctttgcatttcagattgttttataatagaatgtaatttataaatctttttaaagatcacttaacatctttaccttggaaaaactttttagaagtttgctaaataaatatttgcgctactgttttttatattctataggtctttttaaaatcctataggtctttaaggcaatccagtatgaaaaaaagatcctctaagggttattttctttaacaaaatgcttatgataaaaaaaatataaataattggttttaaattataacttttgaagtaatatttattcaataaaaggagtagacctgtacttcagtcttattttgagaaatgttgcttctcttccagtgtatttaagtgattggaatgtgatacacttgttaggtaaaacagattttttaaccttctttagacatgatttgtgactgtggaagtgaaatattttatgtgaaaagttaaaaaaaaaaaacaaaaaaaacacaatcagatgaggtctgctcattctagcccaggtgcagagttttctaaagtgggtgtatgagtgccacacggggttttcagtgtctcttgtaaaaatgacagtgctgtcagtgctttggagttgtggcacccacagcacaaccctgatgtccctgctcctcttgactcgtggttgattagtttggaaaatgtaagatgatgactcagggctttgtgcacctcagccacagtctggttatcctctgagtcctctgggttttttgaggaccatagaactgaaccttctcctgcccttgcctgcctcaccatcccatggtgctattgggattgttagaatgaaaaaatttatgtttagacctaaaaaaaaaaaaaaagaaagttgactgaagtatccaaagtgtgctcatttatttttcttataacagtggcatttcgtcttcaaaggaaatgttatgctgaaccccaaagaaggtaccggggtaaaatgagacctgatctggttgaagaggagatgggtagcccagaatcccggcactctcagatgccactgagatcttcctgactagccctagcagaagaatgccatttgaaaattattatttagtaatttggtcaaactatgcagctgatttaaaaaaaaaattaaatcatgattcagagagtaaccatctagggctagaggtttctcatctttaaaatgataggattgaattggatgaattccatggttcttcccatttccagcattctgtagttcttaaataatttaacttctggctgggcgcaatggctcatgcctgtaatcccagcactttgggagactgaggcagggggatcacctgagctcatcagtttgagaccagcctggccaacatgtgaaaccccccgtctctaccaaaaatacaaaagttagccggatgtgatggcgcatgcctgtggttccagctcaggagattgacttaggaaaatcacttgagcctgggagctggaggttacagtgagccaagattgagccactgcgctccaacctgggtgacagagtgagaccccatctcaaaaataaataaataaataaataagtttccattttagtttgcccacctacacacttttgtatgccatgtgttcggattgtccatatttataagaatgtttaattattagagaaatgccttgaagagaaagttttaatatgaattgaagttgaatgggatagtgctacctaagttaaatgatttcatacacaaaatatgggagtaaaagtactcatgcaaaccacatacgatgtaaccaaaggcaagtgattataacccctgccaaacttgttaggaagactctttttacaatatatggcagctgatcagagctatccagctagtggtttgcctcagttttaagatcaccattttaaggaatgattaatatttattctgaatgatattcatgagcctttagtgctttctttttacaagacaaattaactctagctataaaattaataaaacactgtttttaaaaatgagagtaggtttactatttccattacagaacttatagctgaacattttggaatgatttaatcaatattactcgaggattttaggaaaataattcaggatgattttattattataaggattagaaaataacttcagttttaaattttgaagtttaagttctaagcacaaatgtcttcttgtcccctgattcttgcagtatccatggagaataaatattaaacactcagttcttttccaattaagattaatatatcttcatgaatggagttcatatggtgtttgttaccatttgttcccacagtgaaattatattgaaatttgtggtagtgagaacaccctggtatttaagagtatcctttgctttggagagaaaaggaatacattagtggtaagagcaggaaatttcatcctgtatagagaactgactcatcggtggtcactgggagttgctgccttctggcagaagggagtttaaagcaatggataaaccaactggtgttctctccaaactaaagaagctaaaagttagcttcttgtagcgtagaaaagaagacaaaatttgccattttgtaggaagtatattttgcctccttttccagcagctgcttagtgaaagcatagattgtcattggctaaaactcttaaccttgaaaaaggcacaatatcccttgagccaattgtgtacccaggaagtggaaaggaaagcccggtaactcctctctctttttctaaaagagacaaattaagtctgggactcacttgaaaactacatatccctgaggttagtgtcattaagagaggtattaaaatagaagatggtaaaacatttgtttcaatagagaagataaaatatagaagcacatccaaatgtttaggtgatgttaaataatatttctcctagtttgttaaggtttgttggtctgataacatttatgtttttgtatttggggattttgcatctagtgttatgaactggaagcttttggaaactagtttttaaaattaacatcacaggcatttggtggcagtttagacagtggagaacatatggtacaagtcgcaagggattctgtcttctagaagaagaatagcacagagaaatatacgctatgaagaaactattatttcagatgtgcatacacctgagcgaactatggactagacaggtcgtcttgttcacattaccttatcaagagtctagtgtaatacctgacacagcaggtgtgtaagtgcaaatacgggcaggctcttttttccttatccattatttggggcatacccgtgagcctacttttgcaactcttgttggtttatcatgtggtttccagtgtctaaacaaaagacggcaaattacttcattctctgtgcctccatttcttcactttgaaatgagaataacaataggactgattgcataggttgtcctgaggtataaattatgtattagtatctaaagcacttgtaatagtgcctggtacatagtgagcactcaataaatatttgcttttttcactatagttatttgtttattgtctctagcctttcaccaaatacatgctctataaggatagagccttagtctggttcattactgagtgaccagcaactaaaatagtgtcaaacataggctgggtgccatggctcatgcctgtaatcgcagcactttgggaggccgaggcaggcggatcacgaggtcaggagttcaagaccagcctgatcaacatggtgaaaccccgtctctcctaaaaatacaaaaattagctgggtgtggtggcacacacctgtaatcccagccactcgggaggctgaggcagtaggatcacttgaacctgggaggcagagtttgcagtgagacgagattgcaccactgcattccagcctgggtgatagagcaagactccgtcttaaataataataataataataataataataataataataataatgtcgaacaccttatatatatttgttgaatgaatgaatgatcacaaaagtaattatgtacagttaagagttttgttgagaaataaagcttctgctttattggaaaattttgtctgaatattctgtgctaatcatttaaaaatacttctaaatgaatgcttttcctaaatcccagaaagtcaaacaaaattattggtagtcagagttctcttgttcctgactttgttcagcttgaaaaaaagaaattctgctaattatgaatggaggcaaatgctgtgatttgtctatgttccagttattcttgctgcactgcctgacaaccccccgccccctacaacctcaaacttagtagcagagtacaacaagtttgggtgtttcacagtattacaactaggttctgagaggaaagtaacatcctggcaaccagtgttccaagaggttgaggaggaagcctgaagtagcctaggaaagcatatggcatgtcacttctgctgtactctatgtagtcacagtgggcaccagcttgcacagtttcaggggcagggacacagatcatacctctcgaaagagtgtcaaataattggtaatcattttattttagacagccactgtctgatagattgtttccagaaatggcacaataatttctgaccctgtgtcgacagccttgattaatcccctctctcattgattcaaagcttgactgggagatttattttgatcaatggaacaattagcaactacagcacaaccagatacttgaggattgtttatatattggagtttgtcctctcttgctgatcttgggaattcactatcaccatcatgtgaatgagcttgggttagctgctggatgaggagagacacatggaatgaactgctagacatatgagtgaggacatcttagcccagacggctgccagccagtcgccagcagacaaccaacccatgagcaagcccagcagagatgagccaagctggctcaggccagaaatatccagctggcgcccacaatcgtgagctaataaatggtattgttttaagctgctgagttttggggtgatttgttatgcagcaaaaactaactgatacaggggtgtgattgataatatatcctttccctcacccagtttggaagcacttgtaaaataggcacaagaatcaagctggagaggaagtggctttattactgttaaaggcaaggttgaggaaagtggcttttggtttatcacccaagtagatgtgttagtagtcctctggcactttggtagtgaggcagtgattgacaacgctaagcaactgctggcctctccttgtgtgcattgccccatctgtcttacagcactgaggagtagagccagatgtgtgcacagtgtggggaacccagagagctgagccctctgtgcacggccgtttccttctgcaaatctcactgctcagcaaagtattttttctcgtcctggggaggagtgagtaaggggccagcacgctgggggagttactctaaggagatgcttccacatggaaatgtaaagcaaaaggaaatggccaccctcctcacaatggagatggaggatggaacagattactctggattgctttgtttttttcacatttctttttaatttacgacacaattggcttataccttcatgtgctatctcgtggcacattgtttaatctgtgtgtgtgctgcattcatgccattttgtatggaacgtggttttactcttttaaattgtttgagatttacagctttgttcttccttttatatcatatatttgattttattgatggaaagtcatcaataaaaggcatgaaactgcctgttagaacacttcctaaaggaatctctgatcagttttctgggaatatatgtattgaggtgaaatagaagacttcctgtctatgggtcagttctcagtagtgagtggatattcgttaataaagtgtctgtttttaatctgcctttttagggtcacaaatcaaaaactaagagaatacattgcctaatttataatacatacaaggctgggcttcttttttttttttttttttttgagttttgagttttgagttttaaagctcctgaagaagacagaagtagtcaatcattggttgtgaagtatctgtagcaatacaactgaaatttcaaaagagcaatgctgtgacttcgtaatgggtggctttatatgaaagtagatgctttctctttatctcagttttactttgttgttcttcatacaaacatacgtttaccatgaaaaaagactgtatttatcatgaaaggagactatatacaaatattgaagaaaccaggtgctgaaatagatctaaattaacctcagattaatgaattaatttattcattcgttaattggtgtttattagggtagtaaatcaagataggaccagatatttcattaattttatttcaggattgggtctagaattttagattcagatacattcatgaacgaactttcaattatctgccttatgcactggcatatgcttgttgtttaatgtatccttttgctttactgaagaggcataaattcattgaaagaacctaaatgcgactgagatgcttttttcataatattagtcttggagcaactggagaggaggcacagggtctctgcgagcagtcagtttgagtgatagcctttcagtcaagctttcattgtctttctcacctcacaagacaaagctgattttttcgtaattagccttaatcaagaatttggaccacttctttttccaggagaggagagtatacataaaataatgaagcttttatcatactatctaatcctttctctgttacatcctaaagtatgtgatgtgatttttttttcttcccgaccaatacatgtctttttatttatttgtcaaaaaacttcatcctccagtaggtgcagccttagactatttctttcacaccttgtgccttggggaggctgtctctgacatgcacaggcacttatacgtgttgtggactagctgttaatgagtcgagctaggaaagcccctacataacggccaggctccgtgtcgatagtcgggtggcggcagcgcagtggggcggggggcaagttctcattcattgtttctttgtccctgcccccttaacttccccactagagtggcttaatatgtttatctcttaccttaaaatggaaatttatgctaaatttaatataaacttaaatttgtatcttgtgaggaggatgtagctgcattagaatatctggaatatctcttctgtactaaatatccagtgtctaataataactcttctttactaagtcttgttagcagaggctcaattggcggtggtagaagtacctaaggcagaagagaaggccgtgccaatgttctgctttgacttaattcaggggcacatttaagtaaattaaaatggtcaggtggtgaatccctatagtgaattgaatttatgttctctactttgagtaattatttggtatggcttcaagctgttagattatgttggtgcatgcacatttaggggaagaaaaccaataaggaatggtcttaagcatgagtaaatttgggggcaaacattttccctgattacttttctacctggaagcttgtgacttatgagaaaagtcataaagaaattgaaatgggaggctctagggtaatagagtaagcattttaagtggtaaaaccttcaactgctttgtaatgaaagattccttatcttgtgtgattgagttgcttaggcgaattcatgtatttatacaaagtacagcatttccaagtgtttaaggacattgctttttttttggctggaaaattataaagactgtaagcatgatacctagtcacccagagctttgaattctggctctattgcttaccaagactgggatgcgagcctcattttctcatttgtaaaatagggattataaaaccaacctcagggaaggtgttcagggttgaatatgataaaaaatgaaaagcactgaacgcatagcaaaaggtcagggaaggttctctttctattttccctttgcacctttccttttaaactcacctagtatcatgtttcacattggaatatgagagtaatcactgatcatatcagtgtgtgcagtttacgaagtacactttgccagcattccttttcatatcgtgcgcaagtgaatattattcttgaacttggtggttgttatctgctgaatcttacagtcattgccatttctacactctgcaatgtctatgagcgtttattcaaaaggtgccaaacattagactggccagtgtgttgctgttgcacagtgtagtgttgtcacgggctttttgatggtgttattttgtgtcttgacctactacagtttgcttttgtaatgtgattgtggaagtgctgccaaacaatcgcttgtcatcattataaggtgccactgtaaggtgagaggacagcagctcacctcgtcctcactcacaagggccttggcatctcactgtgaagagagctgctgctgtttgtttgggtggcaagagcagccaagaacatgtgtgacttttgtagaccaagtggaaggtcatcacgtgtccagctggtgctaaacttcttcccaaatcgctggcacatagtgcgttagcagtagatgacctgtttgaaggaattcgtgcatgaatggatgaagtcaaatgtagcatttgtttatattttttatgtaatcaagccactttcttctaaacttgaggaatttcctataaaaattagcttttcaatgaagaatctgcccatgccctgtgggttttttcttctaaaactgttacaggatcccatagaagctcagtcacatgataagtaaaatcgtactgcatgtttaacattacttatttagtctatcttgtgctttgcatgtcagtttttacttattaattgactgaaacattccattttttagagatggtaactattacacaatccttttttccctaagttatatcccacttgtacttttcaacctttggggttttttttttttttcatgttttctaaatatgaagccttcattattttccatctatgatttgaggacattggcagtcttccaagtcatatgagagctggagaacatgaaaaatctgcagcatcctgcgcctaataatttttgtacttacatatttttgttctttttcagttggctcaattttatgttttcttatgctgcatctctttattcttacaatcttatgtatttggagcacgctaggacttctcattcatcaaatatatatcctttcactctacctaaactcctccacaaatgctggtgtaggttccagaaatacaaattaaaaagtttaatgatcgttcctagattaaatggcacatcattctctcccttaccaagcattatcgtgatgttttagattgcagcctgattagggggacgtgaaatttgtgtgttctctagaattagtgctcaataatgacattactaatttggaattttatagttgaagtttgcctttgcccacagccttttgtatcactattgagtgataagcagggctccagacaagaatatcctcgtcatccctcccttccttcctcctttcccatttgaaaatttgggaagacctcagatttatgggttgaaaaattatctggagtcaatgaaaatataatatcaaataacaccaaattccattcaatgagaaccatctttctctaagacttcaagatatccacaaactctacgttgcttctcccaggtagtggggcatgtgggtgcaagagtcctaatttcaaatcctagttccacaagctgccaactgagttatgtaaactcctggactatcagtgttttcaactgtagaatgataccttataaaagggttgggaggattcagtgagataccatctgtaaaacactaagcacataataagatctcaaagtattaactaatttttattaaaattactaggtagactcataattgaatggctgtatttcattgcttacatttgtaacgtcacattttcaggaatttaatgtcatcataaaaaaccaagagcatttattagtataaaaatgatatttaatcagtgttttgaatgtaacttatttatatattcattatttaaaaagaacgtgacctgtgtaatttggtgattttcattagagttgtggttcttcctgaagctagaactgaaaatacagcttcctttattatttcattttattactgcagaatagaaagaaaaaagaaagtgagaaggaaaaaaagcatggtggatttggaagtgaaacaaatgccatactatgatttaactcttctctttagatcttttagagaaatctcgggttgttaaacagccaagaggtgaaagaaacttccatgtgttctatcagctgctctctggtgcctctgaagagctcctcagtaagtctctgtttctatgtggtgttgttgttgttgttgttgttgttgttgttgttgttggagctgggagtctcactgtgttgcccaggccggtctctaattcctgagctcaagcgattctcctgccttggcttcccagagtgctaggattacaggcatgagcactgtgcctgaattgtttctatgttttaattttcagtgtcacagcactttttgaagcattctctttaaaacatactccatatgctttgccccttccttcttaagaatattttttatgattctagttgaagtgaagaacatggtgtatttgcttctaccacaccccagggtttgtgtaatattcttgtacctcaccagatactgtgccatacgtctccgatgtgttgaggactgtgcagatgattcagtcaactcaagtggaatttcagcagctagaactgcctcagtctggacttggccaaagctgattattaggggagggactaatcatacatttaaaaaataaaatggaagaatatgatttttctgtttggggagagaaaattatcagggttctaattaaatgagtacaattctataaaaacaaattgctaggtgaatatttaagaatagtggggaagacattttgcagttgatacaagagataaagatctgatatttgggattttagagaattaacataattccacaaagatactatctaatagctaatagctaatgatgaaaagtagtgaacaaatagttcaaagaagaagagctatgaaaagtcaacaccacttaggaaaagtcatcttcactaataatcaacaaatgcagattaaaacagccctgaagtatctactatattattatatatgtagatatataatatatacatatactacatatagtataatatatgtagaagtatctacatatattagcaaaagttattaaggatcaagctagcagagttgtcactgatctgcttggagcttgtggtatacccatctgtgtagagctgcgggtgttacttcaaagcgaggacctcttataatcagagcatgccatccagtcacaccactttttggactatattccaacaaaataattcagatatgaatccaaaaaccaattggtatgaagacatttatcactgctctatatttattattataaactagagaaaacccaaatatccaatggtgagggaatcaccaggcagaacacatatgttataatgaaataatatattgaatcaccaggcagacctcatatgttataatgaaataatacattgaaggtattttttattataaaaactctggaaagagacttacctagataagtataaaacagagtttgtgctatcacagtgattaaagtcattttaagaataatgctgttactgatatttgggtataatttgtgttcttttgattcaatacttaatataaaagccatgttaccgatgtgaacaagatatcaaagggaatgagatattaaagattggatttattgaagcaacttaacaacttgtgtctttgattcaatagataaacttaagcttgagagggatttcagcaggtataactacctgagtctggattcggccaaagtgaatggagtggatgatgcagcaaattttagaaccgtgcgggtaagatgtagtactttcatcaagctttaaattgcataccactgcattgctcagcgggagctggtagcaattctgagttttctttaaagtgtagctcattctccctaaggttttagaattatacaagaattctatttttgttactttgatttttttactagctcaaaaatcacacaagattgtgaaggccatgcttttattagagcatgtgattttaccatttatcataaggagctttcttattctattatcctggggtttgactcctttaaggttatttttaaattccaagtgtttttatggcaaaagttaatttccaactgcccttggatcatgttaaatcaaaactatttttgagacagaaaaaaatctttttatatagtttcagaaactcatatataaacccgagcgattagcattccacattcattagaaaagatgattttaaataacactatactctgttttctgtcttaatgtgtgatacacttgacatgatatggtaactgggatttacttgcaagtgagacagctgtggtgatggggaaaggggagagtaggatgaattatagataaaacaaaattggcatctgttaattgttgagggtgagtgaaaggacatgcgggttctttccctgctctctctacttttgtatatgtttgacaacaataacaaaaacttacattactcccattgctgtgtagcctagtcatttttaaaaagccagctgttctcaaaaagaaagtatctcttacagtatgtcgttttaaaaaactgtataaacatcttcatatggaagcaatagtctgttgatccctggacatgattttgtttaaaccttgagtccaagactggttttagaaccactttgcctggcacgtaattggcactccgtaaaaatttatgaatgaacagatgcctcctgttacccagtatcttgggctgggctcttcacctttgcaaaccacagtttttctgatatgtaaaatgaatgaggagcttttctttgtatggagttgtgcaagttggttttgtttctagtagcaaaacctcagtgtaaaaaaaacgacatacatacaaactgagctgctgtggttgaagtggaagtagggacccaaggctctgctcccagcctcctgtttcttctgtcttcctctttatgtgccctgcaacccccgccacagcaccagaggtacccccagggttcctcgaatcacagttggaaaccactgaagatatagctttgtcttttatgggtttttttccccagaaataaatctgtaatatgattcattaaaaaagaaaagaaaataactataagaaaaaaatagttgcttttttttttctctccccagaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatggtacatccgtggagaatcaactttgtttgtttaggaaacttgctttgaacttctccccactttttaatgtagaaagtaaaatttttgctttgcattggtttgagaaagctttctaatgaaactgagcagaaatagaactgtggctaagctttgttttttgatgtatacattttatactgatctgtttgattatgatttagaaagaacatcctaagccttcaaaattattattagcagcacgtgtacagtcactttttgtgtccatcccctgccttcccacagagttaaaagaaatttgtgaattgaccggcattgatcaatcagttctagaacgagcattcagtttccgaacagttgaggccaaacaggagaaagtttcaactacactgaatgtggctcaggtgggtgaaacataatgtacagacgaaagtttcttaaaagtctgtgctaattttcatataagtataaacaaagattttagtttacaggctgttacctgaatcgtactatgttctaggcattgggaacagagcagtaaactaaacagataaggatccctgccctcatggagcttaaaattctggtagagggaattagatgataatcagtagacataagaaacaagtgctgtagcaaactagcccgtggtgtatgatcagtgaactgagagcaacagtagagcagagtaggggagctccctggggcagggaaggagactcaagtgaggtgggaaatgactgaagggttttgagcagaacagtggcatgactgccttgtatttcaaagggtcactctggctgtgatgtggagagcagagggtcagggaaaaaggagtgaaagcgagggaccttcgaggagatgtgcactaacccagagatgatggtggcttgaaccaggtagtcgcagtggagtcagtgagaagtggtcacattgtggatattattagagggtagaggctacaggacttgctggtgctagctggtttaagaggaagagaacaatcaagggtgatttaatgtttttggcccaagcaactggaaacatggagttgtcatttactgatttggagaagacagtgggagaagccaaattggcctccctgccttacttcttgaaccccctctacccttgatattggggccagtgaagtctttagtctttgtaagacacaaatctgagctgctgccttctctccttttgcttcaagttaagtgggtgggtgtttggatggttgcatgcctgtatacgtgcatgtatacccaggcagcttctgcagcccctttcactaaaaccctttgtgctatggcttacgcattttaccaccagtcaatgactcaggctagaattaaattactaacttaggacttccactcaggcccccactttgtccaactgtattcttgttgtctcatcctcataactatccataaagcctccataaatggtagggtggagccaggcttgccctctgttgctgaaccagcctttcctactataatccaagaatgcctttatgtctttagctttcaacattgatatcttattttaggtgagttattttggctgtggcaaataccataactttatatatatggaaatttggtttgtagcaatcgtttcctagctatagccattgcctgtccttcctcctaaattactgcttttgctgtcatatctgtccaagtcatcctcactaattcacagtcagatacgaagtaacttacttaatcaaggaaatgctgctgagagcctgtacagcacaagcccacacataggccctgagttgggaagtaagaggttagggaagaccccatggaaacaatcaaaggatttagatgtgtgaagtatggctgaaagggcatatcaaaaagaaaacattgagaaaagccagatttggggcacatatcagaagaaggattaatcaagcttggctatagctgtagatatgtaaagaggattcagagcaatatggctggaaaggtgaagtctgcagtcagagtggcaaatctgcaccagtagttcttaaacttgaacgtgcatcaaaatcacctggtggactgactgactaaacatggtttgcagacctcacccccagtgtttgattcagtgggtctggggtaggaccgaggaatttgcatttctaataaattcaaaggtgacactgctgctgctgctgctggtccaggatcacattttgagagccaccgagtttggacattttcaatagccagagtgggaattgttaagtctgtaaggaagccatgaaaaagcctgtgttgtttaagaagaccctttaggaatatgtatattttgggtctttttaaaattgtgtgttttactcttgcttttttaatcatcctgtatgggaaccaggcccaggtgcctctgactttataagcttattttagtcaccttacatcactaaagaaaactttccacattttcttaacctttggcataaaagaatttggctagagatcctcagctattcggctccttagtcaactgtttttttttttatttttaatgtagtactcagagtatctggttctactgatctattgcctgggaggttttgattgctgtgagaagtgatttgttttattagcctttccacatagcttcaattcctgggccccagcatcatctttattgccccatgcctccttttcccaaggcatttagacctttctctagataggaggactaatactgaaataatagaaactcaagacaagagtttttcagcttctccgacatactctctccttggcttctgatgtcctctgaaatctgatcccacacagcttacctcagtttattccttgctagttctctgttacctgctgcctctgctccgacctgcctatcaccccccatgtcatgctcattctttctgcccatctaaatgctctacctgattgtgccctatcctaggagacttctttgatcaaataggcctcctgagacaccccgcacccccatcagaacctgttttttttgcagtttggcacctgtcctctgcttgtttcctctgtgttagtttgatctccttagctccactctaagctcctggagggcaggccccatgtctgtgcatctctgagtctccaccttgctttgtcacttgccgtcctagaccatgcctgttactggccatgtctgcagcacattccacctgggcttttcctctctgagtttcatgcagctgcagaagtgcatggtcttttcatagtgtgctttgaaactgagatggtgaattagtgcactttgagtcttccctcgtttctacaccccatattagtggtccttaagtgggaatagacattccttcccttactgctttataggataatgttgtggagatttggtggcatgaatcaggctcaggaagtcaggggtggcacattggcagccaggtggcaaattggcagctcctagggccaggtaaagctcaatatttttagttgactaaagggtagtattttctttggttttgtttgtttgctctttaagttttgaatttgagtgcctttagcctggaatgcatcctctaaccccaatagagagagccatcatttcctgttcatttctatcacacagtccctggaaacatttgagtttgagacccctggaataaatattgttgaagaaaccaaagaagattaatattggctgtgaatacactttaaaaaatataaagcaatttatcagaataaattgtcactattagttcagttgtttattgaaatagtggcttgttgaaagtagatagcatgtaactaaaaaagctggacgacattaagatgaaaaagggctcatttacaaaaacatggtgttttgaaattatgtggtgttttgagataacttgaatttataagaagaaaaaggaaaggatttggaaattatatagcctcatgaggtagtagtagacgaaaaggatacttcagaaatcaatataagtacatctatagactaactgtgtgctaggcattattctaagcacttaaattacctattttaagaaagcaaaaactagaagaaagggtattggggaaagatgcatctaaattatattttgatttctctgttttagcatttgacatgcattttctactatggaagcattccctcccttgtttgtttatttgtttgttgccaactcttaggtatattctctaaccctaattggagtagggagggaggtttgggattagcatggaaatgtcagatgaagggaaaaggtgttatcttcagctgtgttatgttgccagggaagtgaatctgttattaaagttgttacattttatttaggaagaaatgtagagaaagtattcccacataatctaacaagttgtgctctttgtaaaataaaaatgtactggttaattttaacagtaataccccaatttttacttagaagcagcaaaatacacacatacggccagcatgttgaaaatagcaacaaaacctcaagctttttctctcccaaggccagttccttgttaggctgctgacacccaacctccaggcctccccaggatgctggtattaaacatctcattagtacttacttactgtatgctctgggcactcggtgcatttaagggtgtttagattcttctgtccaaacctgactttcttcggcctttggattctaagagtcatagagatgcatatgtcttctgcctctttgtcaagtagttctgaataactttaaaagtagataagcacgtaagaaggggtttatgttcattctataacttaaaagaactcattgtggaagtttttttaaatactcaagtgattagtgtggccaggcatggtggctcatgcctctctaatcccagcactttgggaggctgaggtgggtggatcacctgaggccaggagtttgagaccagtctggctaacaaggcaaaaccctgtctgtacaaaaaatacaaaaattagccacgcgtggtggcacacacgtgtagtcccagtcactcgggaggctgaggcacgaaaatcccttgaacccaagaggcagaggttgcagtgagctgagattgtgctactgcactccagcctgggcaacagagtgagattctgtctccaaaaaaatttaaaaataaaaaaagattgagtgaagaaaaaaaatttgcagattccatcagtcaaagccattttcatatatctcctttgaatttccatttctgtgtataagggttttaaaaaatagttatcatattaagtagacagttgtttaattttcacattacgcgagcatttccatttcattacctgattttcataaccatcactctctgatgactatgtaacattactctcagtgcatgtttctcttactaccccctattgttggatgtctaaattgcgtctgatttttctctgttccataaaattgaaataaatatctttgtggtgaaagtttttgcagtatttaaaattagtttcctggtttgtgaaaaagtgtaactgtgtataaacaatttgcctaattctcttaaaggtttgattgtttatgatacaagaaaactggttctgcaaagatgtgaaataaaagagcttcaaatattttttaaaagtatctttatgattttattaaaagtaagcattgtggaattgtgggtgttaagttttgtttgtttgttttttaataggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggtaagatttaaaattttttttgtattgtctttagtagagtggaatggttggaaattaaatcctgtattatgtagacattataagtaactgtaactttgaatctacaaataatccttgtgtagatgtaacacactatcactttgaatctgccaacaaatctttgtgtagatgtaacaaaatttggttgtgtattcctgcatgtgtgcctgagtgtgtgtgtgtgtgtgtgtgtgtggtgtgcgtatgctgagagccagcattttggagacagtactgcttaaaaagaactcgtattagtacctgacttttgaaattgcgtatttaaatttctaaccgtgaggcttccaacaagctacaatgagtatgtctgtggccatttgtgtgttgttagaaagtgtggcaggttggtgccataaagaaagccacaggagggctggacataggttctggccttgccagggctggtcatttcatctgtgagactcagagaaagaggatttggattaggtgatgtgttgagtctcattactgtgatcttatgataatgaattctgctgcagaggttgaaataatttctgctgaagctcatggtgaattttttaaaatgattctatgcttgttacagattaaatatttaaaccatttgtgcttggttaagcaacacatatacctaaaattagaatgatatagagaagatgagcatggcccctgaaaaaagtgatttggaaaataaacattatctacttatgttagaatttcctttttgcccccttgctaactttgacatttagaaggagttttaaggatctattaaaacatttattctcacttttaggagtggtattttagtttggttcacggaaataagaagtagatcgggctcctcctttcttaattctcctccacaagtaagatttgtgaatttctttaaggaaccaggctctgcccagaatgttcccaaagaatttacatgttctaaaaaattagggtcacagaatctcagaaaaaaaacatcagatcattcctttcacctaaaccagaccttgctagcacatgcctttttcttagtatgttttccctcaatcatattctatatttaatagctaatggtaagtactaattgagggccgactgtatgtaagcactgtggtaagtggtgtgtgtatggtctgatttacttttcaaaacagcctcatgaagtagctgttattattatgaattccattttacagatgagaaagtaaagctcctcaggtcaactaactccccagggttatacagctacttagcggcagactcaggacctaaactccaggcccttttaatattttcatttattgcttttctttcttactaagattgagaccaggggcacttcctcacctttcttcccaaagtaacaggttccccagtatctggaagtaagaaaaaaataaatgtggtaagtctctgactcccctgtttctccacccttgtcattactccaagctcctggccagcattgggtgcttcgtagatggaagtgtgtgtgctggtggcttccccatggggtccccagaacagaggtcttcaacacagcatctgcttgtattgctgcccatttagcagaatctacaaaggaaagctaccaatttcttggtagaaagggaagaatttgaggtttctgagttaggagaaatgcttgagtacacacagaaatcactgccgaaattaatttctttctagcaagacctcaagttactatcactaaatgggcagaatgccaaagtcattctttacagttggcagggaaaaagacttactacctagcacattgctgtgctaatctagatttaaatggtttcatgagcaggggagatgggtaagcagagatttcactagaaagttagattaagaagatacattcaatgacatttccaaagtcaaagaaactgattttgttttaattttgctagaaaaggattattgatcttaagccagtgggcaatggcttaatatcatatcacaacacatggaaagtttaaaaaataggataatgaggttatgatgggatatctagttaactttgacttccagtaggtcctaagatctaattagccatgggaaaagaaacacttataacactcaaaggaaactgagttataactcataaacaattcgagtcatttctcaagtgtttattgagttaccagataccagtagtaaacataactgagatattccttgtctgcatggagcttagagtcttagccctaagattgagagtctgtggctgccagaggatgtatcctatcaggtaggaaagtctaatcaggaaactatattacgttttaaaagtttgtttgctacagacctaatcagaacagaagtcagatgttcctgtgtaaacatcctttaacttgatgctgggtgaaataccctatacccttcagcaatccaagaatatttttcacttctggttaattcaagtttctctccatacctgtcttgctgaatgtgccctccttctgcaagttataccatcatttttctcaacactgtttcaactagagacttcagtttatgaaaatgcctgcgttatatttccttttttttttttttttttttttttttgtgacggagtctcactgtgtctccaggctggagtgcagtggtgcgatctcggctcactacaacctctgcctccagggttcaagtgattttcctgcagcaccacgcccagctaatttttgtatttttagtagagacagggtttcaccatgttggccaggatggtctcgatcttttgacttcatgatccacccacctcagcctcccaaagtgcagggattacaggcatgagccaccgcgccggcctggctgcctgtgttacatttctaaatattcttcctttcttcagaggattactctatttcagtggttctcaaatggctgtgcattggcatcacctggggagcttttgcaaattcagatgtctaggctgtacccagagcaattatgtcagaatctctggagatggggctgcagcagcaacctttttaaagctctgaggtgattccagtgtgcactcaaggttgagaccaaatgctctgttagacagtagtctctggagtaaactgcagattccaaacatgtggtgttcatgctgcttggccactgtatgaaacacccttgtaaaacattgggcctcacctactgttcatctgggcatggtggctcacacttgttatcccagcactttgggaggccaacgtgcgtggatcacgaggtcaggagatcgagatcatcctggcaaacatggtgaaaccctgtctctactaaaaaatacaaaaattagctgggcgtggtagcttgcgcctgtagtcccagctacttgggaggctgaggcaggaaaatcgcttgaacctgggaggcggtttttactccgtttaaacagaactttcagccaaggccaaatccaatcagttatatgtctatagcaaatcttataatggccatcaaattataaaaatttaactttccttctacatgcagtaaataatttttctttttttccccccagttccttgagagaatcaagatttgttttttcattatatttaattgttacctccattttcctttttaagccttctcagattaatcttcagttttgatttttaataacttttttaaataaatttatttgtggggaggttagattagcgatttggttggggatttttaggtacttttacctgctttttaatacagagttacagacgtgtttttcttcttttaataaattattcacatacattcccagatgccagcctatattttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttatttgttctgttgttcttcaattgactgtaggaattaagagttctgccttttagaataccctgggcatctctttaaaaactggacactaaagggcgagacttttttaaaaaaatgcgtctagttgtcccatggccctgcagttcccatgaaaatgccttttttagctgagctggtggaaacctttcattccctgtggtctgtctctgaacggaagagggaaactgatgcattaaaccatgggttgatgacacatggatttgactgcaaaacatcccagtaccagctggaagtgctgcctggctggccacatgtgatccgatgtcagtttggaaaatagatcagtagaacattgataccaaaaataaggtgaagtgaattaaaatgcatagaggaaaaaaaatctagctgtacatcctggtagaacagaagaccaacttcccaaaggaagaaaattgtaatgcaaatactctgattccacacatttatgtttggacattcttataactgaaaagatggtctgtgatttctgagaaatatttatagcatatccataaaagaactgctattctttttttgaaaaaagatattaagttaaaaagtaagttgaacaatctacattgatttcagctcgttttctacatacttatctgacaggcattaaaactggcagatattttactgggaaaatctgattggtcattagtgttctgtagaccaaagcaggcagtagtagctgattatttcacctttcatacagtggagctagtttaacacaggcaaagtgctaattactttcagttatggactccttatttatcttgccctcataaacctcactgaaagtgacccatatatggtaagagtatgataggctggatgcaatgattatttcaaataaaaaaatctaatacttgggcaagagtcattgtagtctggtaggtacacctcatgatcataggatttgttttctaaattgtttttaaaagaaattctggctatagtcagcaccttctactctagtttcttgccttcatttggtccttcttatgctagaaagcttataattgaagaggaaggaaacaatttaaagtagatttaaaaacaaaagatgacaactgctatgatttgtaaaagatagatagatagatagatagatagatagatagatagatagatggatccaactgtgtgaatagccagcaattcctgaatcccagagccgggcactcctccccatgtgtcagtctcatgaatcaaagtcttatagtgtatattttatggatatgctgtaaatatttctcagaaatcacagaccatcttttcagttataagaatgtccaaacttggcacggtggctcactcctataatcccagcactttgggaggccaaggcgggcagatcacaaggtcaggagttcaagaccagcctgaccaacatggtgaaaccccgtctctactaaaaatacaaaaattatccaggcatagtggcatgctcctgtagtcccagctacttgggaggctgaggcaggagaatcacttgaacccgggagacggaggttgcagtgagccgagattacaccactgcactccagcctgggcaacagagcgagactccgtatcaaaaaaaaaaaaaaaattcaaacttaaatgtgtggaataattggaatatttggattataattttcttcctttgtgaagttgggcttctgttctgtgtaataatatgtgtgtatttcttccaggtataaaaagtttttagatgaaagcctattttaaaatgtttaagaagagcacgataacattgtttttcttaaaatttgctgtattttagtatatacctggaagaaaaaatgttaagggaaattttctaaacctttagctagtcattcaattttgtaaatgtctaaaaaggagactatttcatattaaatggttttctcatatattttgaggattttttaagtttacattctaaaaaaagcaattcttgttttggagcctgtttcttgatgctgtgatatttaaaaatggaccgtggttaagtgcattatatttttctataggaacagcattataatcagaagctgtcaaaggctttaacaccaaataaatctttgcaaggaccaacagcatattttacagcaataatatagcccaacttccctaaaatagtgatatacactcaaaatcctgtaacttttatataaatgcattgactcatttattatgcaggagactttactgtatgtaaaaatgtagaaacccccaagccagcatgttatattcaaaatttgacctcaaatcaaagtgctgaactataagaaacactaatatgtaattaacataagccatggtctttgtgtttggactgctcgctgtttcaaatacattatattcacctacagactccttcccatttctctgtcccaaatacagagggacagagctgccacttctatttactgtcttcctttcaatatttattgtttttaaagagcctaagagtttttaaaatacctgtcttccttaaagagtataaaatatcatcagtctcctttgttgctaaggagaatatacaaaggggccagtatttttgatacatcttaatttatattggagagtttatgattgatacttgtgagtataaagtagttatgaatcgactgggaataagattttctgggctttgtttttttgttgttgtttgtttgttttgatgttgaaaggatggactcaaagtctagaattcttaaaagaagccctagcgtttaaaatttgattatattatatacttctaaacatagtaagtgctccctatcccaatctatagttggtaactatagtgtgaaatagcagagaacagacaccttgctgtttgcctttgttctctaaagcagcctcagcttcatttagggaggttatgtaatagaaagcccagaaggtacttgtttgaagatgtttctaagttttagttttattccttagtcttcagggataaatgtgggtaagacagtagagaaaaattgcatacttggagcatgggtggaaaactggagagaggagatgagtcattcctggggcaagttcctgcccacttcctcttctggagactttgattcatgagcctgacacgtgggagagggcctggctcagggattgctggctattcacacagttcttgacaaaccaaaaaagtctccacatataaagttgctttggggccttcctattcatctggtggtttctagtctcagtttagctattttatgaaggagagggggcccaagttgaaaaccaggtattaatttaatatttgtattaatggaaaaatgtgttagacctatacaagttagagttctgtgaactgctgccaggctattccttaattttctgcagattattgattattccttaaatttttgaaagtttttaatcatatgtgcagtcccattttcctccaaatttgaacaatgccatcaacttcagcttagatcacaagagaggtgtgtgtctttagccttcactttgagcagtaaggatcatctaggtgacccatgacatgttttggagactttggaggtgagtttgcaatagatgctgatttctgtggggaagtaagttaatttctacatcggtgattgtgctattctatttttgttttggtttttttttggcggggagggggcggtgtttttttagcagtagagtaagttcagacagtcaagtttttgttattagggcatctccaggagaatactctctccttattggtttttgaaaaggagccttagcacggtactacacagggatgtgtccctggggtgggaaaggggagttacttttggattatgatggatctcttcactttttggtgatctgccaaccaccactgccctgactgtttgggtggatgtggaccttggatacatgtcatgcatgttttctttttttcttttttctttttctttgagcaacatggctgtttatttcacctgggtacaggcaggctgagtctgaaaagagagtcagcaaagggtggtgggattatcattagttcttataggttttgggataggtggtggagttaagagcaatgttttgggggcagggggcagatctcacaaagaaccttcttaagggtgggggagataacaaagtacattgatcagttaggttggggcagaaataaatcacaatggtggaatgtcatcagttaaggctattttcactttttttgtggatcttcagttgcttcaggccatctggatatatacgtgctggtcactggggatacgatggcttagcttgggctcagaggcttgacattcctgtcttcttatattgataagaaaaataaaatagtggtaaagcgttgggacggcgaaaattttggggggtggtatggagagagaatgagcaatgtttttcagggctgcttcaagcgggattggggcagtgtgggaacctacagtgggagagattcaactgaagaaagattttgggataaggggtgatattgtggggttgttagaaggagcatttgtcatatagaattactggtgatagcctggatggcatgttttctttttcctgataatttataattagaagcattggattttgaagctttaaagcttcaggcaagttatatgatgtatcattatttcagtcaaactgtttttatcctgaagaaccctcccctagcaaaccacagttcagacaccacaggaaggtattgtggtcctgtcttttgaattgactggatatgggtcttgatccaaagttttacactgatcaaaaatacagcctgaatggtaaaagccatcatttgtaaccatgaataactatcaatacatgctcacttttagaagtttattgctaattaagaactgactgcattttgtgtaatttgtccctttttgcaccagaatgcagtaagtatgacctgtttgcagtgctggtctgttgcatgctcttgtgttaatagcttctctagctgtgtgagttttgcagtaagtggttgttgaataaccatgtggatataaaatacagaatccatacaggaatttttaaaggttatgggcaaatttaatttagttgtaacttaatccttaaattgttttgtaattgtgaagctttgcctctggtttctaatctgcttgtgtgtatttcatggtcctgttttagaagtgtactttgagctgttcatagctacacaatgtgtctgaggacactagtgctttcctttccttctcattatttgctgtttgatgatttagcataatagggttgaaatagctccatgggcacagacttgccagataacacatttgttccatgagactgttgtctaaaaaaaaagtcaaagatctgctcttataagttattaatgttttacttttacttataggttttatttatagttgcatcatatagggacatactttagcaaagcaattgagactttctgatatatggaatgcctttatgctgagtataataataataaggcatctatactagaccaacttcagtttctaattgaaattgttagctctgcgaatttgagcacagggttttaaaaaatttgtgtgaaaatgaggactgaggagtgccctttgtatctgactatatttgtcaaaattattgaaaataaatgtttgccttttagtaagactcttcaagacataaaacaaacaaacttttatccttaactaagtttagcattaacaagataagtcactgacaatatattcacatgtgttatttatgagtttgagtttaaaatttcctctgatcactgcatcactggtgattagaaattcctagctgacttccaggaaagaatgtagttagatgctgcagcataagtatcatttttaagttttcctaagtaagaccaaagttgatttttaaagatcaactttcagaagactctgtgactttttcacttctatcatgtatggagggatttgaaggccagtggctctgcctgttcacaaggagcagtgagctttggctgcaccattacatgtgggctctccttcctcattagaccaggactggccaccattgtgggagaagagtccagtttaccagtggtggagtcatactatccctcgctcccactgccaccatctttgggcgataaagaaaaatagaggtgaaaacaagttttagtgtcagatctacttcttcctggacgatgtggttcttgataaatttattcatttggtgctctcaggatgtacagcaatacattaagccctgcagattgttcagaaatgatttaggcataaagcttctgtcaacaaattcataagagattaatatgaaggagaggctgctgagacttctaagagtgatcaagggtatgggccttctacagagagagagattgtttcttgtcagggagatgctttaatctttgggtctccatttggtaggaacttcatttgttcatacagtcagccaatacatattgagaacttgctaggtgtgaggtgctgtgtaaggggtaggaatacagtgaacaagagagcatggtcagccctcacccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagattgtggagctcactgtgtctttgctgatccttcagcaaaggaagtgagattgtttctagcttttctgtttggggtgcttctctgtcaactaaaagtcttcatccttcaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggtaatgttgaaatgctatttttaaaagtgttggtccttttttactcgtaatataaattctaattcagaagatagcctaaacaagaagccatattcaaaaggctacatactgtatgattccatctgtcattctagaagaggcaaagctatagagactgattacctataagaagctatagagtcagggattgccaggagataggagttgtgagagggttgtggctgcaaagagaattttggggactgataatggtggtggttgcttgacattatacatttgccaaaacttagagaactgtataccaaaaaagtcagcatcactgtaagtagatttgaaaatattttgagactttgttcaatatcaaaaagtattgagtattcaaatttatagtaaaaataggtaacagttactgagtccttactacatagcaggtattatattaagtgctatgtatagattatctcatttaatataatcttaaaataaccagaagtagtgtttgcagagtcttttcatcattaatttaaaaatatatatttgcttttcacccttttattttttaaaatagccagtcttttttcaagtgtaaaattagttatttcaaaaaataaaaaggaattgttatgtttatatttttatttccttttttgtttatttgccttaatattttagtaatgatattacctgttttcctttattttcttagtatcattttaagccattaaggacactgaattctcttttatctttctttccatatagatttttctaatgtgattgttatccccagtggcttagtaaaacaacccatttactcaaaagctaaatcataaatatttcatctttattttagagtactcattatgcttcagaaatgttttatacttgtctggcaccttttagtaacataaatattctaaaagcacgattcattcttttcctgtcttctcatcatgaagagaatgcccaaactttgatgggtaacttaaaacagtttatacagattgtttaaaacacttctaagaatatataggaagattgctagcttgctgtaatgaatagaagacaaataaatgtttacatttatggacagaatgttaagtagacacagaaagattacatttggctttatggatttggctttgtagccagtgttagaaccagtggatagattttcatgtctttccttatgttgaaaatactttgtggtagcgctggcctgttttttttaacacttgaaagagttaacttccctacaacacaagattgactctaaaattaatttttttccttatgattacagattcagaacagaagaatctaggctttaaattcttgggatcaagttctaacttatttccttataaacattgtaaacatacacaacgtaatattgacccaagggcctgttgagtaaatatttggcccagggccagtgaagtgcatgggaaattgctgcagatgggagagtggaatggaaggcagtctcagaacaggtcaagggtgtttgcttcaatcagattatgtcagtggtaggcagctgcattgagaaagttttgggaactgcctgtgacatttgcagtacccattctataaagaaaataaattcagagaggaagggaaatatgataagatggtcaaagtctgttttatggatggtagtgtcgtggcttcatcttgtgtcattggattttgttctgttttgtcttttaggatatagaatggactcacattgactacttcaataatgctatcatttgtgacctaatagaaaatgtgagtacttaggtacagttttctaaagaatgttttagtcctataattcacccttataaatgttctcagtgcctcaatgttaagcattagtattttcactgttttttatatatatatatatatatatatatacacacacacatatatatgtgtatatatatatatatacacgtacacacacacacacacacacacacacacacacatatatatatatgttaaggaactgcagagttctagagattttattgtagccctaagagatcatacacagttcttgaacacatacatagacagctggatgttttgatacttagccaggatccccagtggccatatcacaacacccttttatgaccttcagacaccaggccttaaaggtaccagcctttcttgtatggttggagcccaggtctattccatgactcctgggcatgtgagtactgatcagagtaggctctgagcagccatccagttttttgccaaatcaaaatatccatttcattcccaaaactctaatgacctcttaacatactattcaccgggtattatattaagtttaagtgacataaagggacaacctctggagctgaattaagtgggaccccagaagtggcttaagtgcagctgtagcattgattcagatcatacatgcagagggcattgcatgtgtgactgcaggtggccagggacctggaatttttcggatgacccaagtatgtgcatatgcaaaaaggcttaaagtgtgaaaaattattggataatttcgagtaagctttctgagtccaagatttttgtttttagatcatattccgtagtttattgtaaatgaattaaatgtaggaagactgattttgtgtgtggaaaacaggaaactaatttatgcttaggattactaatacctgactttgaataagtaatttgaaacagtgtataagccttattatcctgcagtctttttagcaagaccagtttagtgagatgagtgctgtgtttcaggaatacagtcacatgctctgaatgaatattaaatcattttctactcatcttttacaaagctttttgggaaatatgtaattagccagtattttttttcctcagtattcaagatattcctaaaagttgtttctctgattaaattaaacaatattctaaggcatcactatttttcaataagaaataaactgtgtttcaaaaaatctgaacaatattgaatgggaacactaatattccacataagcaattcagatctctgattttggctctgaaaagtgaatttcctgaaaattttcctggtacattttgtgaaggaggtaatttgctatgggaatcttaattttcagaatttctgattagtatgttttctttgataaatataaccttgcatttaattattctcttttaagaagaggagaaaaagaacagtggtaatacacttaatttaactagattatctcagccaaaaatccccttgctatatgattgaagaagctcatgttcacataggaacctgggtatataaaggaaatgtttccttccagcatcattaaacaataatgtttgttctggggatgttatgaacacacttgattcctgagagtccacgcttccccagggttttgtgtggaatgaataaatgctggtcagaggatgtcgtggccttgttagcagaaggggagaggaacagaggactttgcctgggtggaagtaggtggggttgatggtcagtggagtggattgtttttggaattaagacttatgaccccataggggcagtccatggagtagcagtctttatttagcaaagtagaagcttcctgacttctgattcagtttagggctgactactcttggaataaaaatgaccacagggtctagatatgcaacaaataaattttcacttatgtttaacatccatttagaaattccacatgaatttctaaaatctaaatctatatgaaacagatattcttgaaatcagtttgattgcagtgattgttaaaagcagcatctcaaatcacagcatttttttctaggaaataaactttattttgaacacatgaacaatttggaaacatagaaaacgagtttccttcttaggagtgaatcaaataatggccttagaagactgctttgtgatttgagacatgttatagaggctgtattgtcacattcatttctgcttttagatttctttttgaatctttgaggtccaacttgtctttttgtaagagtataaatttcagtcatcatcaggctaaggtgtctgaggcaactcccaggtactgttgttctgtgcgaggagagaggaaccaagaagacacactcttcccaaccacaccaccatacacacacctgggatccttcaggaaagagctgattcctgtggcttttgttattgttttgagtctctgctttttgttataactgaacagacttttcttgtgactaagttgattgtgtttgatggtgtaattaggaataattattaaaacaatatagtgaggaaggaaggaaacttttttatttccgttttcccagaacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtatgggggagctgtgagcacccagtcaggcctgccaagttacccctgcaaggaggctgtacctcagagatgggcgttcgaaaccccattaacttgtgaggacaaattgagctgctaaagtggttgaatcgataaatgttcaatagaaatagaatctggaccatgttgactaaaatcttattaatacagaaaatcaaaagcaaagctaatggacttaatgaagagtctaaatatatttttgaatcatctttattattttcaaactctaagctatcctataaaaaatatctattaacactattgaaggagatttgccagtacaaattaagagtcaataaagacttaaggctttaaaaacacaagccatttagcaaaaataatgaattatttgagattttgaaatgacattagggaaaatatttacttttttaaaacacttatttatttggttaatatttgggggaattaattttatgtctaatatataaagacaatgctaaaaacaatcttaattgattaatctttagaatcctgaaagaatattgattagagctaatacttcctttttcataaaattgcaaacttcaaagggaaaaaaacttcttgattatacatttgtaaaaagtatatagtacctgaattacctttaatttcaaaatgttagaacttggtactttattttttttattagcgtatattattaaaagataatttctgatcagcttttctgctgctcaggatatttatgaaagtgttagtattgtttctattttgccccatctacttttaaacagactagaattggtatgtgagaactaaaaaataaaagtaaaaccccagaatatgttcagactcctaaaaaatgcaaaatcctttgaaaatgttatgataacatttttggagtttattcttgcaaatcctgaatggtaatagaatttattttgatcttgtctgtgatttagacagatggaatttaaacttggaggcgaactcattatgagagtgtgactaacatgtcagggattttttgatggtgaaggaagtggctgcaatgtagatagtcttggagtatttttaatagttgtttgacattatagcatgcaatgtgcctgtcattgagttacatgtgctgcttataggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaaactcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaatttttttcaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcaggaacctataatcccaactacttgggaggctgaggcaggagaatcgcttggaggcagaggttgcagtgagccgaggtcacgccactgcactccagcccgggtgacaatacaagactccatctcaaaaaaaaaaaaaaaaggaaaaagccttctgggctcttctctttttctgcttctagggcatcttagacagaactctctctagatttagtaaagaccaactaggattagagtttgctatgtgtgtatttggtgagctagatagtagaaggtatgtgtctggtgggtcagatttcatagagcacacccatacccacaagtaccttctatagttgtctttgaaaatgcagttatgaggaaactagagtgaagaatatttttgtgtttagtttgtgtgcctgatatttatatttacagaaatgtaagtagacaaaaccctctggtttgattgcagtcagattagaacatatgttggagaggatcctagtttaaaaaaaaacccaagaaactttctgtgatgagttgcttttgttattctcaattgaatgaattttttttttgcatcttaactctattttattgaggtatcatttatgtgaagtgatatgcacagatctgaagtgaacagttcaatttttttttaaccattatatatgctttagtaaccaccacccaggttaagacgtaaaacatttccattaccccagaaagcttcttcattcccctcctttttttatttttacagcttttctaagaaatcttaattaataaaccccaaggttgtgaatatattatcgtatattttcttctagaagctttatagtttcagatttcatatttaggtctgtttcccccccatgtagatatcctgttgcactaataccatattgaaaacagtcttcttttcccattgatttgctttgtggcctttattgataatctgttgaatgtatatgtagggatctgaacttactaggccattccatttatctatttgtccatctttatttaagccaaagagtagacattatttttataaatggtaaaagagaaagcatagtaacactgatgccaaactagctaagatgtagttgtccacgtaagtgtgtaatttcacagttgtagttaggcagccataatcatgaatgtttaagtattagttaggacacagggattgctgcagtatgatccaaagctagcaatgatttaagcaagattgatgtttatttcttaagtaacttctaagtatgaggactccagagctgacagggcagctccttctgttttgtggctctgccgtttcctgggcgtgttcctcgtctgcatggaggaagatggctgtccaccgtgtcaacatttgcagccagcagtaagctggaggagacgaaggggagtgcctgtcccttcttctaagaacactgactagaggctgcagacattacttcccctctgatcctagtggccagaagttgctcacctggccacatctacttgcaaaggaggttgggaaataaagtttttccctgggcagcaaagtgccctgttaagaaaggagaacagatatagggaggaaacagtgttttttatctttttattgaggtataatacacatacattaaagtgcatggatcttaactgtacagcttcttgaagttttacagatgtatgtacttgtgttaccccatccagaccaagtggtaaaacattcccgtcagtccagaagattcccttgtgtcccttgcatgttgatcccccactactacctctccccagaggtaacagcaatactgatttttaaccatgggttagttttgcttgaacttgatataaatggaatcataactacagcatgtactcttgtgttgggcttcttttcactcaatgaaatgtcagtgatacttatccacattattgcatttattagtgtgttctttttaaaattactgtgcctgcagtattgtatttatttttaggtggttataaaatgatttgaaataatttcaaaagtaatgactaggtttcttaagaataacataattgttttgctatgaaacagttatatataatactttgtgaaaacatagacaattatatccataggaggcagtttataacctaaaatctttgtgatctttaaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtaagaaattcagtgaccatatttaataatgaatgttttaagtggtcaaataatacggtgttttttcacatgctgttagataaaacagaattttatgaaaaactggatgtaacctctgttttggaccttcttccattaggataccattttgtgctaaggtcaaaataagacttaccaaatccacatttgggacttgtatggcaataatattaatttttagaatatgcccaaggtaggttcgtaggaggtggtttgtaatttgatacacttatatttgtgtagaatcatagaagggtagaattagagacaggttggattaccacttgtcacttttcccatgaagaatttggctgcagagagaatcagtggatgggtgaaggtccctctctttgcctatatctataccagttaatcaatagacgatacgagcaggtaggattcacagtgtcagcattactgctaggagagctggattagagaacgtagcttggacccagggccatacagctttcagctggtctgtcctgaattgcatttactcatccagtcccagacagagtgctggacaccgcaggcccagtggtgcatccccatgtcctgtgagctctccacaggcagagagaactgtgtactgacgggcggctgttgcaggagagaaatcaagccttattccttctgccctcaccagagaggctgctcctctgcaggctgaagaaggcttgcccctgaatactgctggagggctgacatgcctgtttcatgggcctaggcaggaaatgggcgattttcatttaactgtactggtattgcctacacattattctcactgcacctggcctttcacaggaacatcaacacacctaggacacttaccttgtattataagaagatctagaaactccagatgtatggtgcggtctctgatgcctaatttagtaccctaatttaatgtaggatttgggtactgtttcagttcccattgctaatttccggggtattatggtaaacaggtaccataatacagaatgtgtattcactccctgcctggcatctagtctgcaggtgggtggagtgaggtttagttctaaagactgatgttgaaaccggggtccaggatggagaggtcagggccaagtccagttcttgctcccgctgggtaaggcccacgttccttagcgtcccgttggtctgggactgtttcttggtctctgcttttattctcaggggcagaaacaatgtttaaaatattttcaggaattaactgagtgagtttaaaatagatctgaatttcttgcacaccctcctggcccaggttggtacatcattataggtatttttgatacaagtattgcctctactaatgaaatcaagaaattggctttaataccacattttcttagaatacatagttatgaacccaaatttactttttcagtgtttactggattaagtttaatttgtggaaaattctttgataaatggatgattgctgaaagagcaattacacttggaaatgaagctatgttttataccactgagaacctgataccatgatagaagataaaactatttttgtaactcagaaaactcactgtttttatttttatttttttaggtctggtgtggaggtcctatttaatgaattagaaattcccgtggaagaatactcctttggtagatcaaagatattcatccgaaacccaagaacagtatgtaacgaaaacctttacactctgaacttaagttggaatcgtataggaaagttcttaaaatatgtttaactttataacattatatgaggggccaccatgaatgccacaaaacacttgtgtgtttatctacaaataatcaagaggcagggacagataagggtaaggggcggtagaagaatgcgtattttttatgaaccatcaaagtctttgctctgacagattgtacaacacttaagaaatcacaaagaaactgttaggacaacggtgcaacattcatagcaactgcaggtaaacagtctgtatttgtaatacctgaattatacattaattttaagaactacagccccattatttagaggtacaggaaagcactaaaatgaaaattttttttaagttaaaaaaaatacttttagcattctacctcatagaaccccaaggaaatttttttgtcaatgaatagatgagtgtgaagtgtaatgagtatagcaggtgactggtaatttggaaacgttaagattttggaaagtatttaattcatttaagagaattttccagcatctaccttccattagtaatttgcatcctcatagacagtgtgaaggtaaacttaaggtcaattcagcccctctctgatttgtcataaattctgaatcactggaataaaaattgtaagtctttcatgaatccatcaaaataattttctcatggaccattatccatatcatatataatgcatatggtttttcagttctttttttcaatgtaattgactccaacatgatggcattttgtctcctgaaaattcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcggtaagagtctcagtcattttaaatcagtaataacaatgctaatttgccaacatttattatgtacttaccatgtatgtgatttttacatacttaattctcccaacaacctcatgagataatggatgttcttaatggttcttttttttaaagatgagaaaactaagacacaaagctgttaagtaatttgcccacagccacatagctataagtggtagagctgggatttgaatccaagacagtattagagctcaagttcagtgtgccataccgcctttcactgatctagctgtatttggttggaaatacatttttaatttggtcatcagattggaagagacaatatcctttaagcttttgatttggttgggctagtttttcaaagtaattggctattctttggctattctttattgtagcagctttgaaagtggctttaattccagaaagctaatgccatgtttttgtagatttctggttttggttaaaggattgcattctctttagtccttaggtatctggctctattaactatagggaaagattcaataataaataatgtttacctagttaatatgaaatttctttttggcatttccttcctcatttgattgtagagattttgttgaaggcataccacaggtatgagagaagcctgaaggtttgcctcagggttaattgaaacttgggctgtgttctcacaaaatgaattaagtttgcactcacatctcctttcttatattcttcctctttttcagccataaagagactttgctatagggctgtatataatcaagacataatttacgctgacctattctcacataatacattttagtttattatttccaagttttacaaattaatgaggtatttaattgattaagctaaagaaaatcagcttgagagtatctttacaatggctcatgctagttaagattataaccagcagtataagtcttaaaatatgagtctgcccagccatgtgaatgatagagtcattcatatgcattctgcagaggcactttggactgttgtcacccagcctggtggccgtggagtctcctctgtacacatagtaccactccttaactctgctgcagattcataatgctccgttttctgttagcctgagaaagggaggaccaacaagaggaccaaaaagtcctcaaggagccctttttataatttcttattttgaggtcattaagaaaagtttacaagtgtgctggattcatctgtcttgaattctacaaatatttttgaaacacattagcaaggtggacaaaacaacctaattcctgacttcctaaagtttatatctagtgaaagacaatacgcatttaagcaaacaaataatcagaaaaattatagactgttgtaagtgctaggaaggaaatagagaactgccataaagaataatggggaggcgggatgtgacctaagctagagtggtcaaggagaaacttcggggaggggccatttgatcggaaggatgagaaagaacaggcaatgcaaaggaagctcaagtactatttgtaccttttctcccaatataaagcttttatatcatcagattttaaaaagtcacgatttatcattagttcatgatgtcaggagttatgagcaatattagttggtagaatgaaaactaataatagccccagttttagagaatgcattaactttgttctaatgttacatctctttcaaaatttgaactacatacctcaaccagttcactacatgttactcaagccagtggttaaactcattattttccctcaaccagataactcaaaagatttcttgaatgctcctttttagttgctgattacttttaagttattccgtattttgtaatatttcatgtttcctagagatgaattttcaagtgagatatacttattttcaagacatttattaattaaaaaggaaaacacagaggtaccaaatgcgtgtcagaatgatggtcagatactgtagctgttctacagctacatctgtggaatattactctggggagaatcctagagattttccacctcttcatttaacagctggggaaactgaggcccagagaaggtgagtggcttgtctgaggtcccagggtcctcttggattttctccctggcatccttttttgttcctctgcccatctattgataccatcacccattacctctgatcttccaagacatagcctggtagcctgggaaggcatctctcccgcctcagagaaggggggctgagccagctggcacttctaacatgagggattcacaatgtgactttagtacttcgaaatgctgtgaattttcattagggatgcccccatgtttcagtgtatattccaaagtgaatactgtaaaagctcacttttctagggagtattccagcagcctccactccagggcgtcagccctagaagtaagaaaggcctctgggcattgagcttgttgagccagagctgggagcctcactaggtcttctttgaccttccccacctggaagtaacctctgctgcctctgagcctgactgttgtgctttctgtgctgcatctctcccagggtactgtttatcctttatactgttgacctgtgttcacttcaactccttgagggcagggatgcagtcagatgcacatttatatcctcatggtcctattaaaaggctttatgcatagtagaggctcaatatataaatatttaattgattgatagcagtttacttaaatttttagctgattttccagcttgaggcagagtaaaagtagcaaacctaaaagaaactagggaggtttagaggtgggtccagtaagtagcatggtgagaaatgacaccaagaagagagaacactcaaaagcagatgcagaactcagtgggttttcattcaatatgcatttactgagtatctgccttgtgtggaaccctgtattataacagcatgagatgaagaaaataatgataataatgctgtgtcctgagtcatttaggaattattttatttagcatccttaaagcatactttggattaactgtaataatattggattgtttgatattttggtttctttatgtattggtttccagaaggagtatggataattgagtcagttagacgaagtgagcaaataccctttctcaatccttgtatgcgttacagatattaactacaactgccaatatcttccccttttatcctacagcaacaaaagaggtaccagcagacaaagagttccgccttagtaattcagtcttatatccggggttggaaggtgagtttaaaagaagtatgctttatttattttgggttttctggtttttcacaaaggataatgtctttagggtcaccctgcagaggaggggctcctctgtctcctgcctcgcctgtaaacagtcagatggaaagaataaatattatgggccaaacggggaccctggtgaccatgtcttggccacttccttctaaccagctttctttttaagcgctttgttctctaagcaggaagtccttgaaataatacccgtacatgatttcagtatccctttgccccgtgttttcgagaaaagctgtggtacagaaggctatctcacagccattgctttcatactcagaatccctaccccagtgacttccgtaactgtccagtaaccatcttgcaggctacccatcacgattgaaagatcctgagatctggccaggtctagtggtggggacatggaggagccgtcacagtggacagcctggttctaggtccttgctgccaaggcttggttcaagggtcactgaactacaggccacaggctacagctagcctgcttgcgtgttctcatacaacctgcaagctaagaatggtttttatatttttaaccgttgtttttaaaaaagcaaaagaagatgatttctttttttttttttttttttttttttttttgtaggtgggatgtattttttttattttttattttattttatttatttttttttaattgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgacttcaagcatctgtttaacaaagcacatcttgcaccgcccttaatccatttaaccctgagtggacacagcacacgtttcagagagcacagggttagggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcgtctggccgggcggggggctgaccaccccaccaccctcccagacggggcggctggccaggcagaggggctcctcacttcccagtaggggcggccgggcagaggcgcccctcacctcccggacagggcggctggccgggcgggccgacccccccacctccctcccggacggggcggctggccgggcagaggggtcctcacttcccagtaggggcggccgggcagaggcgcccctcacctcccggacggggcggccggctggagacggctaacccccccatctccctcacggacggggcggatggccgggcagaggggctcctcacttcccagtaggggcggccgggcagaggcgcccctcacctccggacggggcggctggccaggcggggggctgatccccccaccatcctcccggatggggcggctggccgggcagggggctgaccccccctcccccctcccggacggggcggctggccgggcggggggctgaccccccacctccctcctgggctgggcggctggccgggcaggggggctcctcacttcccagtaggggcggctgggcagaggagcccctcacctcccggacggggcggctggccgggcggggggctgacccccccccacctccctcccggacggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggcgctccccactcagatgatgggcgggtcaggcagagatgctcctcacttcctagatgggatggcggcggggaagaggcgctcctcgcttcctagatgggatggcggccgggcagagacgctcctcactttccagactgggcagccaggcagaggggctcctcacctcccagacgatgggcggccaggcagagacgctcctcacttcccagacggggtggcggccgggcagaggctgtaatctcggctctttgggaggccaaggcaggcggctgggaggtgtaggttgtagtgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaacgaaaaccagtcaggcgtggcggcacgcacctgcaatcgcaggcactcggcaggctgaggcaggagaatcaggcagggaggttgcagtgagctgagatggcagcagtaccatccagctttggctcggcatcagagggagaccgtggaaggagaccgtggggagagggagagggagagggagagggagagggagagggagagggaggaagatgatttcatgacatatgaaaagtatatggaatagagatttcagtgtacataaataaagttttattggaacacagccacattcatttatttcacagattgtctggctgctgtagcactacagtggtagagtcaagtagtagcgatagactgtgtgaccttcagagccaaaagcagttaccatctggcattttacagaaaaagtttactgatccctgatctaggtcaacgatacttcagagcctgttctgaccactttcctgtgaggagactttgtggtatggtctggatccagaggggtagtgcccaggcctggagccctttcagagggtagacgctgggtcccgagtccagcaacactgactgaccttgcccaggccctcgacaacttaagggcttagcagttgtctcacagcaaatggcaaaacacaaatctgaacatgtagagtaagtgaaactgctgcctgcaggctcttccttggcctcatggctggaccttggggccccgtttataggcgagagaccttagaggaaggacccaaagtccaccttgaaaccaggtgtcctcctggcccccataaaatcagtttccagcaactaatggaaagaagtcactggtttgggatcaatgagatcattttggttttggagttttaaaaatatcttgaataaaaaggacagctacagttacattccaggcaataataatgaaagagatacagtggcctttagaggatcattggaatcctctggcccctttctgagaactgtttcatcccacagatgtgtgccagcttgtggtgctgtagtcagatttttcccattgtgtatcagggtacgggaggctgctgttccaatcaagtggaaacccatgcttaatgatgtcttcattgtccaccttctcatagtcagtttggggctagtcaccttcgccttctttaacctgttgatttatcacaatagcatgggtgttaggacgatcatctcttcaggtttttttttcaagtcactgtcaattcctttatttttaaacattctctcttttgggtgattctgccctttaggctcgaaaaattctgcgggaactgaagcatcaaaagcgctgtaaggaagcagtcacgaccattgctgcatattggcatgggacccaggtaggcccgagaccccaaggaaggcggtgggtcagcagtaacgtcatgtggaaccatgaaccctcggcttcaggggcagaaaatgtttcactggcttgagctactgagcacgtgtttgcttcttgctctttccaacattttgttgtggggtggtggcacatgcttttgcgtttaccatttggtggtgactagtgtctctctttttctttcttcattgaaaaccagcagtaacctttcctgccttaaacttttctgtaactccttttcaaatgcatcacaggcacgaagggaactgagacggctgaaggaggaggctaggaataaacatgctattgcagttatttgggcttactggcttggatctaaggtacttgatgcacatatcccaacactccatcctggaattctgcaataatcagtccttacctctagcctattaggggatgaatgactacaattaatagtggctcacactggtgcatgtcctagccgccagatttaacacacctggaaacattagttcagtagtatgcataggaagcttaggcatgcataggtcaataaaactaattgcttactaaaaaggcactagtatcattgctctttaaaacaaaacaaaacaaaacaactcttaaataacatgcatgtttaggttcccccccgcccccattgatgaatgctagcagttttttagaggttttctggaggggttgcgcatgttgggaatgttcaagtttgggcttcagtcggtcttctgcaacatgttgacaatggaaatgcctctaacatatgtcttaaaaatattaatttatgaatgaaatttttttttaggctcagtgtggcagctattgattattataagcaaaatattacatgtgcaaagaattatcatctgtgatttaacagaaaactatgttcatgcacagctagctatgattgccactgaagaatcccaggaatttcagcatcagctgtttgttttcagaaacaaaggcctcctgaaatactctcactaatccccaggcatagtcgtgggctctgtgaacatttcacataccccaagggacaagatttttagatgtttttgttacttagaaaatcaaagtcatctttgctaaaaatgtgtattccagttagaaacacaaacatcaacagagtcctgtgttttgaagtccaccttgtcaatgttgtaagcctatcttatgagaaaatgagaaaagtcaacatctgcctgcataaagagctaatttgccaaaaactaaccagagttgttcatctgtgcttttcctgaaaatctgtgaagaacaaacttgttcctctagtcaactgagggaaatgtcatagcagaagcaaaaggactcttaggtgggtcttgctaagatttctccatccagtgagttcatttcccagtctcagtactataatatcttgaacaatcagtgcctatttgtatcctttagaatagcttgcctaagattattttttccctaagagtaatttttaaacctataagtttaacctataattgcttcagtcttcctgtatattttacttttgcgaccttagctaaaattgaatttttacacgtgccagttttcattttttgactggaaggaatttttgagttttgttagttttggtttttgtttgcacttcagagaaataaacttttttcctcccagttttctaagtgattgttcacaagagttgtctttttatccatccaaagggatgaactcaggagtgcatagcttcttcagcccaatgtgctgtcagcaaaggggagtctaatgacatcattagggctgttactcagagtttgaaggctttgatatgggagtgaaagagtgtggagaaggcagcgaacagagagagagaacaggagaaaaaaggaaaggaatggaagtgaggggtgggaaatgattaccttgggaaccacacagattgtccttctctggaacagaatctcagtgcactgaaaatataagcgctgcaccagcctgacaccaattctttgggtttaaattgttatgcactgttcctctgtcattctgaaatccttattcataaattggctcttctgtttggtgggatatctttttctggtcatttgtgctgtctgcattgggctgtctcttttatttactatctaaaacattctaggctcgaagggaattgaaacgcttgaaggaggaggctaggcgtaagcatgcagttgctgtcatttgggcttactggcttggactgaaggtacttcctcaaccacttgtttctgtccagggtgaacttcataaagcctagcacctactaaccctgagaaaatgattgattatgcttgctgatggtctgcacagtcttgtagaatgtcatcttgcttaattttgtacctttttcagaagaaacctatacactaatttttttctgattttgtgatttctatttctttaaataataggtttaatgtaatagcaatatggcatgttttattcaagatactatgttatcaaagttctagtttgttatctttatgagtgtaaagttgtttttttaaaatctgtgagacacagttacaatagttgagctaaaagctgccctacatccacagtgaccagcctagggatgccaggcttttgtttccctttttgtaccaattctgctccaataatggctgcctgcagtagagctttcttcagagcgaccattgttctaattgttcagcgttggaaccaaagggtcttgcatcattaagcttacagattttgatgaatgagttcagagattcagagatcagtggatcattcatgttaaagagaacctcgaattcaaataccttgtgattatggcagggtttattttgaagtggtgcttactacagtagggtacacttatgtgtacagaactacacataagtaaataactctgagctctgagaagcccttagaatattctttacaccatgtaaggatctgatcttccaaattcaataattagtcaccataggaagccatccatattgcctttttgggataattaggcccctttctgacagtattccttatcattgtttttactttaatcctatgacatttaatcttactccaaatatttgaattattatctgagtaatcattgactctaagtctgaacaaccattagaaatatccctgaatcctgctttgaacaatctgcattttttttctgcaatttcagcctataaactttagtaaattatcctttttgattatactgaatattcaccaagtaatatttgaagtaattaagaagtaacttaaatatgaattttaacagatgttctatttgaagaactccaaacaagctctataaccggtttttttaagtcaaacaaaagtaaacattttcccatttaactcacatctttagttttctgggtttaactgcatatgatttcaaaacatttttgcattaggggtgtacactagcaacctacaaagcaaattcagtttgtaggggaatattattttagcagaagttaactgggcttactctagacataacttttttcctctcagtctccaacaaaacagaggtactttactatataaccagtattattgtatgaaataagatcaaacttacttgaagtccaagaatataataattttgtactttttttttctaaaagagaatcatgttaatatgaatgataattttgccctctcaaatgattgacttttcctgtggaaataattacaaagtgcagtgggcctttttaagactcccagttccccagggggcaccatcgtatatgccagcatgttgtcaccaggcttttagtgtctgtagtggtattttgggagaaataacctgccctgtcgaatatcaaaatgcatatagcaatgagctcagttatgaggctcaactaaatatcgtatgacttcaggtatatttttaatgatatattcttatgtaacttcatttgtctgctttcctatactattataatttcaggagccaattattaggtaacatttttcttctccttgtcccttctcaccttagtttgagattagaaatgtttgtggatctgacagctctgtggctaaaagacagatgataatcagtaactagaatatgaatacaggcatacctcagagatattgcaggctcagttccagatctctgcaataaagtgaatatcacaataaagtgaatcacacaaatgttttgtttgccagtgcaaataaaagttatgtttacactgtctctactgtagtctattaagtatctaatagccttatgtctaaaaagccaaagtacatactttacaaatacttcattgctaaaaaatgctaaccatcatctgagccttcagcaagttgtaatctttttgctggtggagagtcttggcttatcttgatgtcgatggctgctgactgatgagggtggtggctgctgaaggttgtggtggctgtggcaatttcttaaaataagataacaatgaaatttgccacatagattgacttcctttcctgaaagatttctgtatagcatatgttggcatttgatagcattttacccagtgtagaacttctttcaaaattgaaatgaatcctctcaaaccttgccactggttttgtcaactaagcttatggaatattccaaatcctttgttgtcatttcagcagtgttcacagcatcttcatcaggagtagattccatctcaggaaactactttatttggtcatccataagaagcaactccttgttcatttccatcttatcttgagattgcagcaattcagtcccatcttcaggtttcacttctaattctagttgttactatatctgccacatctgcagttacttcctccactaaagttgtgagccccctccaagtcatccatgagagttggaatcaacttcttccaaacttctattaatgtggctgttttgacctcctcccatgaatctggaatattcttaatggcatccagactgatgactcttttctggaaagtttttaatttactttgcccagatccaccagaggaatcactgtctatggcaggtatagccttataaaatgtatttcttaaatcataagactgggaattactccttgatccatgagctgcagaatggatgttgtgttagcaggcatgaaaacattaatctcctcgtatatctccatcagagctcttgggtgaccaggtgccttgtcagtgtgcatgaatattttgaaagttctctcttttctgagcagtaggtctcaatatggggcttaagatagtcagtaaaccatgctgtaagcagatgtgctgtcatccaggctttgttgttccatttatggagcacacaggcggagtagatttagcataattcctaagctgtaggatttttataatggtaaatgagcattagctccaacttaaagttagcagctgtattattctttaacaagagaatcaacctgtcctttgaagccagacattagcttttcctctctagctatgaaagtctagatggcatcttcttccaatagcaggctgttttgtctacattggaaatctgttgtcgagtgtagccacattcatgagtgatctagttagatcttctggataactttctgcagcttctctatcagcacttgctgcttctttccttaaccttcatgaaaagttaataaacttttcttctgcagcttcctcacctctctcagccttcttggaactgaagagagttaggacattgctctggattaggcattgcttagaggatattgtggctggtttgatcttatatctagaccactaaaattttctccttatcagcaatgaagctgtttcacttccttatcatttgtatgttcactggaataacacttttaatttccttcaagaatgtttcctttgcatttataacttggctgtttggcacaagggtcctagcttttggcctgcctcagctgttgacatgccttcctcactaagcttaatcatttctagctttcaatttaaagtaagaagtgtgtgacccttcctttcagttgaacactgagaagccattgtaggattattaattcaatattaattaatttctatattgctctgtcttagggaataagggaggcccgaggagagggagagagatgggagaatggccaatgggtggagcagtcagaatacacacactgtctcttgattaagttcaccatcttacagatagaaaaataatgaaaaagtttgaaatattgtgagaattatcaaaatgtgacagacacagaatgagcacatgctgttggaaaaatggtgccaataggcttgtttgatgcagggttgccacaaaccttcaatttgtaaaaactcaatgtctgcaaagtgcattaaaatgaggtatgcctgtaaaaagaaaaactgcctataaggtatatgttacagtttttaaaccttaacagtctttagaggtagagaatgggtctggtgcaaaaatgctcagagggaccaggttggtcgtacagatgaggaaagcatcagatgggaggtggatcagaagcaaagggactcgtgtagtttggagcgtgcatgcctcatctaaaggcaacagcagctactttggtctccctggcacttattttataggactaggcctcagtgttgctagatcttagacaactttaagagaaatctgcagtctgaattgttatattgagttcttaacttaaaaatatgcatacagaacatttatctgtaaactgaatttggatagaagattactagcttacatcccgtaatgtagaaatattttgaacatgtgcagttaaacctagaaaactagaaagaaaagaaaaaagatatgtaatatctgaattattcagataggctaatattttgctaaattctaactctcccatttgtatctggatggtaataaatacttaagatatttttccttcaatttcaaaatttaactatataatttattcatttgttatacaaacactccactttgttactgttatttgttagacattagtatatgaagtaaatataacaatgtagcaaggaaaaaatgtgtgaactaaaactataatatgatgttttaagtgctctgatagcattaagtataaagtttggtgggagtagagatgatagagaagaattaatgcaatgaaatggaagataatggtagtttcaaagcttctatttaaattcttagccatattcagttctcagtgtgtaggccttatcttctatgcaaggcttttggaaactgatacagttcttcagactttttttttctttttgccttttacaaaacaatctgaagagaacattattttatataatttttaatgtattttaattggggatgagtttgcagctgtgcctgtaaaatgtttcttgtcaaatcatcagattcttcaaaaactactaagaggatttaaaacatcaattcatgctggtttcatcattttacatttcttaatttctttctctctgacttaagatccactatatgaatgtgtttcaattattttactaaatctagaaaggacacttataaactgacttgtttgacattttttcatttttaatagaggtgtatcattatggacctgtaccagccacacattaaccactgtaacctacatcttctttttaaaggtacgtagagaatacaggaaattcttcagagccaatgctggaaagaaaatctatgagtttacgcttcagagaattgtaagttgacactttatatctgtggataatcagcattgtggaattacccacctaatatcaccaactccataaaatgtgccttttcctaaatgacaaaagtgactttttaaataataattaaatcatagctgtgacactgagagttagttatcttttaaaatcatcttcttccaaattctggtagaattgtgtcagaaagagttgttaatggcccgtatattattaatacagtgtttgccttatttgacaagagagaacttttgggggaaagtggatccaagaaagccatgactttaccctgtgaaactgccatgagctgtggcagggcaaggctggcaagcaaattagtggggagaggggtgacagggagccaggctgtgcagctccacccacatggactctggagttctccatctttcagagaggtgtatgtagtgctgaacagactgcaaactctggagccagcccccactgccacttagtgtgactaaggaactggattttaaaatttaatttaattttagttacttaaaatgtaaatataaatagcctgtgtgactagtggctgcattttagacaatacagctctatagagctagctggtattagcattagtgttaatatgagtgttagcattactattcttcttttctcttaaccatttggtagaactcatatttccccaaccagtatgaaagagtggagtagagacttcccagatgagttacagttctataaattccaaagttaaataaattctactattgtctcgtttatttgatcatgatgtatgtaaaacagtgtcttttgtggtatattttcctcatgtagtattttctgtcaacccaacacaggtgcaaaaatacttcttggaaatgaaaaataagatgccttccttatctccaatagacaagaattggccctcaagaccttacttattcttggattctactcacaaggagctaaaaaggattttccacttgtggagggtaaaaaatgtcatattacatcttttcggagactttcttatttattttgagtgtttaaaaacacataaaatcaaaactgttaacacattcttcctttgcctcaaagaggattacttgaggactttggtgattttcccccatgcaccatattgagtttctacgagagcccctgcagcggcccaggcgttccctgtgcggtcgcctctcggccctggctggaacggggagcacagggctgcattttctttccattccaggttccagctgctctcaagtagttcagttttttgttcatttgtttctctctttgtctaaaggaatactgtaggacagagaaatcataaaatttggacaccttcaggcaacatagttaaatcctgcaaattgaagagtttactttatcagatgtacagaacagataatcagataatacatgtgaacacacacactttgatgggtgggaaaaaaggctttttcctgtccctaaagatagtaacacattctctatctaaattacagggaagctggaaatctgttttatactgccttttattttagctctcttattttgtataagaggacatggcatgtaatttagatgttgcccagcatggaacacgtggggcacttgtatagatgttgaccttacttcgataacctagtcagttgatatgtggaatgttaaatatatgcagttatcagatgtaataaaatcatgagatggaagggcatgtatttagtaaatgaatgctcagtacacacatcctccaggaaactttcctgcccagcacggtgggcttgtttttttgttagaatcatctatgtatagagtgacattattgctgattagcttgataagtggtaccatacaacataaggaactagattctgagttctgttctctaacagcaaatttggcgaggttcatgaacctcttaatggcttgtctcctttcttgagtctaacccagaaactgttttcagaaataatgacagggagctcccattgctggggatctgcaccacctctgccctcccctggctttgcaatctcacccatccctccattggattggaggtgggagatgagggctgtttattcctgaagggagcctttccatggaaagggtcagcagcaatgctcacacttcttcatgcaattatttcagtagcacttgaccacacctgtaactgaatttctaggaatgctcatctaaaaaacctggccctgctcctctggccactgtctcctctcattgcagcttcagggatggagtgaaaggggatatctcaggtccctcatccctattgtaaaatggtagtggggggatttggagcagtggttttcaaactgtcatagcatatttgtggtcatgaaatcaatttagtggattactaccagcgtttttcaataaaatgcaatagaatagaaaatagcagagtgtacaatatatagaaaggattgagtattgttttgtgacgcttttgtgtcagttttctctgtatgtgtgtggaaatgtgcttagtggattgtgatgcacaatatttttactgtgagtctctctagaagagtgacagcctcaggactagaggatttccaaggattgacatagtgggaggaaatagtacttgcaaggcccgtgcccactaggccctggtgtgttttgaagaagcattccaggttctgcaatacaaataatactctgacgttttccaagacaaactttttaaaacccacaagggaaaaatgtttttggccttttttagtgaatgttttgtactttctcccttattcttgttgctgataaattgtcttagcatatttaagaatgagtaataatttatttatataaatgatgttttgtttctttcttctcatatctcacagtgtaaaaaatacagggaccaattcacagaccagcagaaacttatttatgaagagaaactagaagccagtgaactcttcaaagacaagaaggctttatacccatctaggtattatggctttgctttacccataaaattcaggattataaaagtttctcaagtatatttgtacgccgttttgcctggtgtttgatttcagtcttagatgagtgatttttagttctgtgaatcattttataatcagcttgatgtaaacacatttatttgagctatggcttctatagtgcagtttaatgaaatgaggttacgattgttggtttcactccattagcattagctcaaacactttactaaataattagaagtcatttaacataaaaattatataggctgttaagatacgtttgcattgtaaattcctgttccttttccgtagttttcaaagactagccaaatttctgttggcaatatactttaatcaccattccagtcttcctgccatagcaagcaaggtcagaaacttatttgtaaggtaaatgaaagagcgagccaggacagtactttttgagtgttgcttgagcactggtctgtggtgccctttggtctgctaactcaacggatatgacttctgtggcctgtacagcacgttcagttcctttattttagacaccgtggactcagaaaaagaaggaacaccaatcccaagttcagcaagtgaagtccttggtaaagactgtttatcccaatagtcttacatctcctgcattcatcacttcctcccagcaatctaatcccattttcatctggtgtttataaaaaagtagattgtacaatttcaagccaaatctgtaacaactttaagcttcttccaatgaatggccaaagaaagaatgtattatatgctgagtatattcacatttattacgtaaattatgtttatattctctgtgactttatacacatttaaaatatcttccttttaaaggattaaaggaatatacattgccagactcactgggtttaaatattttaaattgtacaacttcattggttagctgatgtggctacttgaggtgatacatactcccttaagtcaaacacagtgtctaaatccaaagttgtccaaagtgcctgttatataaagcatattcaaacaggagaatttgtctgtatgcttgcttcagcaactaattttattcagctttttttttatacatttttaaattagggaataaccttcttaatgaacatttcctgtggatgactcttcagaaactacaggctggaaaatacatctttgaggaaacaatttaaaagcctgttagcatttttataatttaaaacacagttgaataggaaccaaaaaaagttaacttcaagccaagtcctttttgggtagtcttatcagttttcagggatagtggcacactcaccccacagcagtgagagaggtggaataatttagcctcccaccaccctgcaaagtggcagctcttatgggagttggccttttatatcctgagagctgtgaaacgctgaccacctacgtggatttttcttcccttatcctccacccacaacataagcatttaaatttgtatttgcaaattgccagaactttgtagctcaaaatgaagcttatagattccttgaagcagcagtttttccttggtgcctttgatgaacctgtcctgaaagagtcccccgacaagtctttagggaaattgatatcttagtgataagtgtacagttaaccttttacaaaaattagtttgtttgggaaaaaaaaaattgccctgattctgaatgtttgctttggttacttctgtccatttagaggcatattctaggagaagaggcttgattctcctttcatatacagatgctgcttaacttatgatgcagttacacacagataatccatcatatgggttatgagtgatttctatcttgattgttccatgtgatgagattattatcaaagtcctgcccaccaaatgccatgatcacctcaaaaatatatttgaaataggtttaaggtttcatttccaacttatatttaggacagatgcaagcgtaatgtataaaataaattgaagtcaatttttatgaagttgtcatatgtcatatgaagttgaaaatatcataagttgaaaatgcatttaatacacctaacctactgaacacaatcacttagcctagcctaccttaaacatgctcagcacacttacattagcctacagttgggcaaaatcatctaacacaaagcctgttttataataaagtgttggatatctcatgtggtttattgaccactgtactgaaagtgaaaaacagaatggtttatgagcaccactgtaaagctgaaaaaccctaagtcaaaccaagtcagagaccatctgtattgcctacttagaaccacagttacatgttaatattaagtgttctatagttttcttctaaagtgattgccctggatctgttctttcccagaaggcctattgattttcttattctctgcaagaaatgaaatttttctttagagcaggtgatggtaatgatttcagctcttttcactgccacatattgtttgaaggcgttagtaaatcctttgtgagcagctgttaactttatattaacagattagaagaaattgccttttccttcacatgaggccatgtacttgagtcttagctgttgttcttatgagtgatttctgtcttgattgttccgtgtgataagattattatcaaagtcctgcccaccaaatgccatgatcaccccaaaagtgtatttgaaataggtttaaggtttcatttccaacttatatttaggacagatgtaagtgtaatatataaaataaattgaaatcaatttttatgaagttgtcagctactccttagaatcaactgacctgtttcctttttttagtggtactttcatttgaaactatttctaatgtgcaggaatttttttcctttagtgttgggcaaccattccaaggggcttacctggaaatcaacaagaaccccaagtataagaaactcaaagatgccattgaagaaaagatcatcattgctgaagtcgtgaacaaaattaaccgtgctaatgggaaggtaaaaatgctaaccttgaagactgataagaagtacctattagttgggatagtcaccctgttttctgaatgtaaaaatttgcatttcatgttctcagtagagttaactatgaaggcggctatttccccttacctttaagcttaggtggaattttgcttgttctctgacatttttatgaaataaaacatattatttatgttctttactgcgttcttggtttacataggtatgtttgttgaaggatattggaatttttgcaaataatgccttaaactcatggaccatttttgagtatttgtgatcattggttttatactattttttattttgatttagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagaggtaaaggttcaacagaagatttctgtgcttaatctctcagccattgatttaaaaaatttccatatctgataatcctatcgcagtttatatatctgccttgctaatttgcaaattttggatattcacccctatgtaaaatctccgactcagtttttcagtaattgaataaagttaatcacttttattggccagtttactttactttttgagactaatacatagaaatatcaagatgttttaaattttgttttctcctgttttttcttctatgtatcaacttagtaaatgtcttaatgttcatctctaatctgggggtttacattaaaggatacaactaaaataaaataaccgccagttaattttaacctaaataatttttagtgttctgtgcctttagcttaaccaggactcctggcttggatgcagtggttacatgtaggttctggagttggtctcactcactttatgataattttggccaaggcatttaatttgtgtgtgcctacctactttttctcatctttaaaatggggatagtaagagtgcctacttcatagcattgttgtaaggattaaggattaaatgagacactggaggaacagggcctgtcacataacacatagtcactgaataaacaaaagttaacaaatattgatcatatgtagggacatgtgtctagctaataatgttactctctggccaaccctaaacttagaaaaatccccaaagcttcccttagcctgtttaccctactttggatcttaacttaaagggggcatatcaaatactaggacagtgattctcaacctcagtgacacatgtaaacagcttgggaactttaaaaattctgatgcccaggccatacccctatgaaatcaaattagaatttctcagagggggcacaagcatcatgtttttttttttgttttgttttgttttttttttgaataaacccagatgattcccttgcacagctaaggctgagagccactgccctaggatatttgttggaagtgttgtcattagggttttaaccaaatcactgaaaagttttttaatcaagtccttcagaagagttgcgggataggtccatgctcctcaaacctgaatgtgtaaacccatacctggaggttgcgttgtggtttcatattcactggggctgtggtagggcctgagattctgcttttctagcaagctccaagtgatgcacatggtgcttctgctgcatccaccgactttaggtagaaggggattaggtaaccttactaaagtgctctgagcaagttggaagaaacactgcttttgtcattattgtttaccttgggagaatggattccaggatctgatgttttaaagagactgtaagtatgtttttagccaagcctgtaaatattgaccttctaaggtatctttaattatgaccgactcttggtttgtccttgcagggctcagaagcagctagtaaaggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaaagggttaagagtcagagagtaggccaggcgcagtggctcacgcctgtaatcccagcactttgggaggccgaggcaggcgaatcacgaggtcaggagttcgagaccagcctggccaacatggtgaaaccgtctctacttaaaatacaaaaaaaattagctgggcgtggtggcgggcgcatgtaatcccagctactcaagaggctgaggcaggagaatctcttgaacccgggaggcggagattgcaatgagccgagatcgtgccaccgcaatccagcctgggtgacagtgtgagactccgtctcagaaaaaaaaaaagagtcagggaggcctctttgatgtggtgacatctgagactggtataaatttgaaatttgcttcttcaatttctcattagggttctgaatatagaagttagttatttgcatacaggttggggcatccccagatttattgtatctatctatgtaagtgttttggagaaatctgagttactgtgttgattatacttaattggttacctttcaatagattgtttacctgcttatatacttctttgcatgtctagattgctcaggaaattatattcttttctaattaagaattttctagtctattctgtttcaactcttcctaaaagtctttctaaaataaatttacacccatttctgcccctttgtaagtcagactctctttgatatgttaggattttgcagtgctgtgggcttttcttaagttctcattgaagtgtttagatttgggtgggaggttgggcttcatgtatactctatattggaaattgctgttcggactaaataacttttcttgttaatgagatctttctcataaagaaattaggaaaaaaataatggttggtgtgtttcagttaaggatttaacacgttagggcctattagagctttaaaatccctttataatagttgaagtttttcataatctgggagaatgggctttggtggggctgctaattctcactcaccatgggaagatcgtatgtatcccagacagcagaagctcctcagtgtacagacgaagcagtctcatagttgtcccactatgtgaataaactcatctttacacagaaaggaaatcacaccaacatccagaccacaaagtactgctatttttaagcatttcccaaaccgggattctaggaacattgcttgtacaggatgctaataacgatgtactgtgaaaaaattgttctctgatggaaatttaaaatctttcttcactacattacatctcagagtccctgaaatcttgttgtgattctcctgaggagctttgcggggatagcgtgtggcgtgaatcctaaacatagtcaaccacagagctccttcagcagctctcacagcttgtgttcgaaggtgtgccatctgggaaagggggacagttcgcttctgggcagcaagggccctgccctgtcacagagggcgtgtgatgttctggatgccataagctttcagtaaacagttgtctgagcgaagatttataatgtggccacatgaagaaaacaaacattgggtagcattataatgcctttcattctccagtgcctaattattgattggtctcataaaaataaaacagttcataggactctacatagcacccgtgggtcccttccccaggtggcacaggaagcctgcagaggaagtttgtaggtaaggatcgtaaatctccttagggagcattttgaatttaaacgaaaatgtccaaagtcataggcaggggcgcctgttcctttatgtgtcagccctaagtggcttcgctagctctatagaaccagtgttgaaaaccacatgcagtttagtgactaagcccttccttgctttttccttcccagaagtagaagtagttactctaacaaacctagattctgtaatcattatggataagtggatgtcagtttatggaaagagagtcaaagtcctgtttactctttagtggattttttttttttttttttttttttgaggcagagtttcgctcttgttgccaaggctggagtgcagtggcacgatcttggctcaccgcaacctccgcctcccgggttcaagggattattctgcctcagcctcttgagtagctgggattacaggcatgcaccaccacgcctggctaattttgtatttttagtagagatggggtttctccatgttggtcaggctggtctcgaactcctgacctcaggtgatccgcccccctgggcctctgaaagtgctgggattacaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagatgacggtggtcccctaagattgtaatggagctgaaaaattcttctgtctattgatgtcacaggtgttgtaatgttatagtgcaaggcactactcacatgtttgtgctgctgctggtgtaaacaaacctacttcactgccagttgtctacaagtaaaagcacatacaattatgtacaatatgtaactcttgataataaatgatgttgttactggtttatgtatttattatactatacttttttttttttgagactcagtcttgcactgttgcccaggctggagtgcagtggcgtgatctcggctcactgcaagctccgcctcctgggttcatgccattctcctgcctcagcctcccgagtagctgggactacagctgcccgccaccacgcccggctaattttttgtacttttagtagaggtggggtttcatcgtgttagccaggatggtctcgatctcctgaccttgtgatctgcccgcctcagcctcccaaagtgctgggattataggcgtgagccaccacgcccggcctatactgtactttttatctttattttagcgtgtatgcctacatgttaaaaaagttaatagtaaaacagcctcgggcaggtccttaagggggtatttcagaaggcattgttatcttaggagaagacagccccatgtgtattattacccctgaagactttccagtgggacaagacatggagatagaagacagtgaaattgatgctcctgaccctgtgtaggcctaggctaatatgtttgtatcttagtttttaacaaaaagtttaaaaagtaaaaataaaaaaaattaaaattttaaaaatagagaaaagcttatagaataaggttataaagaaaatatttttgtacagctatacaaagtattgtgttttaagctaagtgttattacaaaagagccaaaaaacagccgggcccagtggctcacgcctgtaatcttggcactttgggaggccaaggctggtggattgcttgagcttaggagttcaataccagcctgggcgacatgacgaaaccccttctcaacaaaaaaattaaaaaattagccagccatggtgacacacacctgtagtcccagcttctcaggaggctgaggtgggagaatcatctgagcccgggaaggtcaaggctgccctgagccatgattgctccagtgaactccagcctgggagacagaccaagaccctgcctcaaaaacaaaacaaaagtgtcaaaaatgtttttaaaattgtaaagtttataaagcaaaaagttacagtaagcaaaggttaatttattattgaagaaagaaaaaattacctataaagtataccgtaatgtaatgtcctaggccttcacattcactaacaactcactcactgactcacccagagctacttccaggcctgcaagccccattcatggtaagggcgctagacaagtacactattttttatcttttatgctattcttactgtaccttttctattcttactaagtttacacatacaaataccattgtgttacagttacctacagtacaataacacgctgtagcatctaggtttgggtaaatgcactcactctatgatgtttgcacaatgacaaaatcacctagtgatgcatttctcagaatgtatcccttttattagatgatgcatgactatatttctaaaatcaagttcccaaatagagtaaaaactaaagtgaatttgtttcattaaacattttaaatatatgtgtgtgtatatacatataggtatacacgtgtgtacaatagatacacatatatcatttaagttatacaattggttttctgaatatttgaaatccaaacaactaatccatgttccttttaccttgaaattctaactggtatgaatgccatgaaataatacattccatgttattgtttgttggaggaggattttctcttttctatgaggtgaagataaataatagtgcttacctcctaggattgtcttaaagcctgatctaataacatagtaaatggccaagcacagtgtggtatgtagcaaatcctcaatatatcttgcctattgttatttctagtgtgaatctttttttttttttttttgagacagagtcttgctctgtcgcctaggctcgagtgcagtggcgagatctcggctcactgcaacctctgcctcctgggttcaagggattctcctgcctcagttccccgagtagctgaggttacaggcatgcaccaccacgccctgctaatttttgtatttttagtaaagacgaggtttcaccgtcttggccaggctggttccaaactcctgacctcaggtgatccgaccacctcagcttcccaaagtgctgggattactgtcatgatccaccgtgcctggcctctagtgtgaatattaatcaggaattatagacatggaaacagttaatgtaggccaaggttattggggaaagaagttcctatacatttattacacttacaagtggtcttttttatttattttgaggcagagtctccctctgtcacccaggtcagagtccggtggtgtgatcccggctcaatgcagcctcctctgcctcctagctgcaaacgattcccctgcctcagcttcccgagtagctggaattacaggcatgcaccaccgtccctggctaatttgtgtatttttagtagagacgtgggtttgccatgttggccaggctggtctcgaactcctggcctcaagttacctgcctgccttggcctcccaaagtgctgggattacaggcatgagccactgtgcccagccacaagtggtctttgaaaataaaaatgtgaaagtgtttgatttttaaaatgtgtgaattttcaataaacctgaaagattttttttgagacacatacatacaagtatatatgccagagatatatctcaggtagttgaatctggaactatagctgtcctttcctcattgctttcaagttgaaaatgaagaacccatttaaaagatcagaagcactatccttataaaacaactgatgaattagaaacacatttgccttgtttcattctagcagataatgtttgcaaaatgtggcctctttagaccttgaaactgaaactaatggatacagagcagagctgtggatcctcacatcgctgggggatgtcagtaagtggtcagtggttgttaggttgactcactttagtaatgtgccattgactgagaaaaccatccctgagaatatggaaaatgtcataatgctatgctaattatgagggtagagagaagagatcactggttttggaactggaagacctggtttctggcccagcgatgcagctctcatgtcccccagtgatgctatcctcagttcagggatctcatcatatacagttgggggttcctcgcagcaccagcacagggatggtgtgaagaaccctctgtggatgctcaattgtacacctaaagtcatctcttatcccagcagtggtccacatgatacactgagggaaaaatacactaatggattttttaatccatgaattaatttctatacactaatggattttttaaatttttataatttttatataaatattttaatgggtattaaagatatatgtggtagatcaaacacatgattttatgcatattctgtaggtcactattattttgaaatacatttaagctagcaatagctattagcatactatgcagataacgacaaaaactatgtaggacatatgtgagtaaccagtgtttagaagccatagactagagggttgccaggccccttccttttgtgaaattctttacctcattttctcaatttgttgataatttaataggagccccctcccatattttttttttgccgtggaaaaatggaaatataacctgttggtctttccatttgaaacacagaaataattcttagcctttctaccttactagaatatgatgagttaatgaactttagttttcttagggctaaatgaggactactggaggtaaattgcattgatacaattctgtgtaagaagtgctcatgggaagaagtgatacaggttgagtctcccttattcgaaatgcttgggacaagaagtgttcccagtttcttgttttggaatacagtcatgtgtcatttaacttggggatgtgtactaagaagtgtgtcactaggtgattttgtgcaaacatcatagagtgtgtacttacacaaacgtagatggtatagcctactacacacataggctgtatattatagtatagccaactgtttatagcatgttactgtactgcatactgtaggcaattgtaacacaatggtaaatagttgtctatctaaacagaaaaagtacagtaaaaatacagtataaaagacaaaaaaatggtacgactgtataggccagctccatcataatcttataggacccccatcgtatatgactgacagtgaattaggtatgtttacatcagtcaccacaaacatgagtagtgtattgccctacattaggagagctatgacgtcactaagccataggaatttttccgcgcttatgggaccaccatcatatatgtggttcattgttcactgaaacgttgttaggtagcccatagactgtacttgcattatacttaatgtttcagtcttaatctgaaatgttccagcaagcatttcctttaagcatcatgtcagtgctttaaacatttcagagtttggaggtttcagattttcggattaggttagggatgcgcagcctgtactcgtcaagatcagtatccattaaaatacaaaagcaagtgttattgtaatcatgagctgttttgtgtatactttaatttgttttattcttttctcctaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 242 - DNA, 304809 bp, Homo sapiens
gagggaggagagttcacttttacttcagtgtcagcgcgcggcggccgtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctgtaagtgcgccgggcgcgcggggttcctgctggccttggggagctccctccccgaggacggcgttggagaagccgagggagccggttgcgcggcgcagaggaaattggaaggcagcaactgcgcggctggcaaagttgggagctggagttgcaaagggcagtgaatcgcgtccccccgctcctcccgccccccaattcctaatatccagctggcaacccagaccctccactccgcatacccaaacggggtgcgcgggcagtgcggggattgcgctctgggacagaccaggttgggattttaggggtatcaggtgaggagtccgcggagctccgggtcgccgccggcttgggccagggggtggcgtaaggcaccggattcttccaacccagaaggggaggaaagtttgtttgctgtggctacaggtgggcaccgcaagtagggcgccggcgcactctgctagtgcaaagccggcttgactggaagggcgggagtctcctcctgtcccgcgccctcgaacttcacctgacccgctagagccattggcctcacaggtgtaagtccctcccctctgaaaccccccaacccctttcccccccgctcccctcgcgcgggaggattgctgtgtggagaggacgcggcactaggctccggggaatccggcgggagcccgcgtgacttgaacgagatggtgtcgattacccagccaggggctgccctcggaaataggttgctttggccgatcgtgagtggatggagccagattaacaccaaccacgtggcttcatgtgcagagttcagagtcctaaacatgtgccaggaagcatttcctttaaaacaaacagaaagttggcctgctgtctctccaaggtggccctgtcagtgaacccaaggccgaagaccacaggttaatctttgcccaggctggccttggtggcagaggtaccaggtttgggttaaggtggtgataccttcagcagggtgttttgtttgtgtgtgtgtgtggttttggatggtgcgtaaggccactgacttgcttaactgaaaaagggctcctcaacttgtgtaggttctttcccctcctccccgctggcgtgtcaaagatgggaggttatctttcctgtgttacccttgcagtgagggggaggcctgaggactacagcctctgtactctaatgcattcagcagttgactgagacccagctttttgccttttggtaaaccacacagacagcagagcctcttgggttcaagagggaacgctgtgctcattcagtgtttgcagtgccaacctcaggtgggacccagctttttgccttttggtaaaccacagatacagcagagcccgttgggttcaaggaggaatgctgtgctcattcagtgtttgcagtgccaacctcaggttggtggaagtactttaatgtgaccagctctcagaatatatggtggcttcactgtgtcaaatgataagataaccacaaacttctgcaaactaggtgaatctacatgaacaaatgatttcttgctatcacatgattgatgtcggccctcatgagcaataaatagtgcaaaatttccgtgaatgtggtacatgaatgcagcatttctgtcagtccctgcatgtgcatctgtgatgctgcttgattttcacggaataaatctgtgttttaagtgcactccagaagaagctatcaagggagtccagatctggcaagcctgaagcccactccacagggccgctttctttggaaatcttcatccagctttcttcaccaatgtggtgtaagggggtggtgtgccatcttgttggaatcactcccggttactttccctccactcatcaagtgctggcattcaagttggtcacttaacactgtcaaaatggaaaatatttgcctatgtttccagactttcttgtcaccctgaaatattaaggctttaatatgacagttatctcattaaaatgaacacttttataattttggtttatgaatggtgtattttcagtgtattcagaacatgatatctagcagaatagattttggcgttaataggcattacctaacattacctattcatgcagaagagggctatttggtgtgttagtgtaatttctggttgttgttggctttctgagcctcctatcaacatgagactgaaaatcgtgctgtgagctcttcatgggaaggctagggaaggataacacaggattgtccttgctctgttgtgttctagggctgtgctttttcttgtttattggtttggtaaatacagtttcagtaaaacctcaaattataagaaacaggtgttacccctagcatttaaaaataaagtagcaatacattgtaatttcagttctagtgctgaacgttctgagtataagatgtttgagactgggctttaaacacaactttttggtagtttgaattaagttgtctattgcttattttgggtctgagcttctgttctgctctctctcctacccacttgactcctcatttaattcagtagttcttacacaaagtaactaactcagctcagggctgctatggtctttctcctctgtaccagactgaatgtctgtaaaaggccacataataaattgtacttgagggatttctcaatgagttctccatgaggcctctgactcttctcaggtttctgacagatgcaagattgctgaagtcgccctgatttgcacacaggagcactggattgaaattaaatagactattttctatttaatttccactgttattggccacatcttcctgcaatctgtgaagctatttttgtataatgttaatactacaaacaaagctgaaacaattcagtaacacaattctgaagggaagaggtggaagaaggaagtgatagtaggtagctgtttaaactaatgcagacatagacatagtatgtactatatattgtatgtatagtatttttctatactcaaccaaattaagatgacacttacgcttaggtgtgatttgcgaataacttgtgttgttgtaatggattatgatgtatctgccaaattaattctgaaaacacattgctgccatgatctgtcgtaagttttgttccagttacttgagagttaaaaacaccagcaagagcaaaagaggggtttgtgactaggcagatgacttcacttaccactgataacccaatcaacacttaagtgactacagtgggtctccaatgattgcataggcaagaactgtggttttctacactacaagattcagagccttcctttcatgagatacattgtacaaaaattggggatcaatgtttcactgtttgcttcttttaaaaagtgcaacctaagtccagcatgttgtgggggcggggaaggggaagttgagaaagattctggttgagcattattattattttttttttaggcagtatcttgctctctcacccaggctggagtgcagtggtgcaatcatggctcactgcagcctcaaacctcccagcctcaagctgtcctcccacctcaccctcctgagtagctggtactacaggcacacatcaccacacctagctaatttttgtatttttttgtagagatgggttttcaccatgttgcccaggctgagctcaagcagtcctccctcctcagcttcccaaagtgctgggattacaggtgtgagtcaccacacctggcctgatactgtgagcttttgggtactactctctgctcttatctgaatagtgaagttactaagttagttacctggaaactggagttttggggtggtcagtgcaactaaactcttatccatctacgatgaccaatctgagatgaaatttaagttctgaagtagttaaacgcagttgtgtaaaaggtgattgaataagtcggtatttagcatagctcagctgtaacatcctatcagtgctttcgtttgaaccatagaaaggtatacgcagccttatcttgagatactgtcttcagtagacaaaaagtcaagctgctccctcatatgctggtgttttggttgagcttttcaaaaggatctttaaggtcaacagctaaagtgttattttagtatggttttaactttaattacacatgctgttagccagaatgacttgtttgggagagtttaagcttgtaataccgagtttgttttagaatttagtgttatttggggtgttaactcctttttctctagggaaccaatgacttactattgccatctaccctcttactacacaagctttttaacagccccttctatttaaaaggctgggcatggtggctcacacctgtaatcccaggactttgggaagccaaggcgggtggatcacatgaggtcacgagtttgagactagcctagccagcatagtgaaaccttgtctctactaaaaatacaaaaattagcctggtgtggtagtgcatgcctgtaatcccagctacttgggaggctgaggcaggagaatcccaaataggggaatcccaagcaggggaatcgcttgaacccgggaggcagaggttgcaataagccgagatcacgccactgcgttccagcctgggcgaaagagcgagactctgtctcaaaaaaaacaaaacctagtatacaaacagatctaatgcttaccatgtcttcatggtaaccaaaagagaaacaaaggctactcaacgtctgatttgatagggtcaggtaagtcctacagggcaggcagtttaatatgggatatggaacaaaggtttgtgaacataccaagggctaggtgcttttcatgtgttactgttatcatcggctcattatggcctttgagagggccagtggttttccatttcacaaagaagctgaaacccctagtactatgtcaaggccaccctgctagctggtggcagaggaacttgaaagcagcactgtcagatcctggagcctttcctcattgactgttgcaactttgctgcccctgaatcataaatgttcaccccttctgtgtctttaagtagtttgtcatgattctctcaagatgtagaaacctctagctatttatgctggatgtggtggtatacacctgtagttacagctacttgggaggctgaggcaggaggatcaagatttccaggctgtagtgtgcaatgattacaactatgaatagccacagctctccagcctgggcaacatagtaagatctgcctgccccccacccaacccaatctctcttatttatttatttatttatttattttgagatggagttccactatgtcacccaggctgaagtacagtggtgagatctgggctcactgcaacctccacctcctgggttaaagtgattctcccatctcagcctcccaagtagctgggactacaggaatgcaccaccacacccagctaatttttgtatgttttagtagaggtggggtttccccgtgtggtcaggctggtctcgaacttcctacctcaagtgatccgcccggctcagcctcccaaagtgctaggattacaggtgtgagccaccacgcccagtgagaccccatctctaaaacaaacaaacaaaaaacaacaacacaaaaaaacctgtggccattggatagtgtgctcatttataaatagatgcataaagttgattttgctgctgaattttttcctcccaagaaacagcatagaatacatgggctttttttttttttttttttttttgagacagagtcttgctctgtcacccaggctagagtgcagtgacatgatctcagctcactgcaacctctgcttcccgggttcaagcaattctcatgcctcaccctcctgagtagctgggattatagtcatgtaccaccatgcctggctaatttttgtatttttggtagagatggggtttcatcatgtcggccaggctggtctcgaactcctgagctcaaatgatctgccttcctcagcctcccaaattgctggtattacaggcatgagccaccatgcccagccttacatgggcttttcatagaatacatccaagcttcatcaaaagattttgtgtatacttagaaacatcccatctcttactgtgaggtgctgaagtgaaaggcttttccataataatatagtgatgtgccccagtgattgctaataggataatttgtaaaacatgctttattacatacactgcccataccttaaagtctgggattgttgagaaatgaaatagaaactttagtagtgaagccgacctgtgagctgatactttgtcaccttactgctctattttatttttctctcttgagatgcagtgtggtgctgataaaatggcagaagctttggagttgaatagatgtgggtttgaattctgacttccattgcctgcctcagtagccttggggttttctcctgtaccttgagaggtgtgtggaaatgatatatctatagaggtggctgatgtggttcctggcacatagtgctaaacaagttgtaatggtttcaattaattgagcacctaatactagcaaagtatcgtgatgaatgaaacaccgcttagctgctgacagcttaccagagaatctgggtgacaagtaaaaatgcttatacttttagtgcccttccaagttctgtggaagagaagatatgagaaggatggatttggatggcggcaatgggagggcttcatgaaagttgtgaatttgaaatgaccttgaggaaggtcagaggaaaacctgaaaggcgtgctagtatatttgtactgtggaatcttctatttatataggcaataaaggacaattggagctgtcctgaggagagtcacctgatgcaaccccttactgatgtaccttcttgttctttgagatggtttaaaaaaagaaacaccccaaacttttcattagagacatgggtgagtggcccagtgaagtgagtgacaggggaggcaggtgtggcaagacagcgatgtgagcatttggtgccctgtctgctggctgcttagcggcctcttcactgtgcttctgggtttggctgtcttttggatgaacagctttgccagagggttttgccgaggataggtgaattcaatgagaacaggtaagaaaatgagttgtacttagagcaggacaaggatattgacaactgaattctctagggggtagggtttctctcacctcatttttcttcattctctccattaattgtggcaatgtttacctttcagatttcactgatttacggtcctgcaatgtccagcatcccagttttattgaagaatgacttagactgtgtttccaattcattggcaattgcctgaggaactttcatttagactttttgtgggattttactaagctctaattggaccttcctttaattttataatcgtgtattgtgtatgacttcttcttgccaaggtgcctaagaggagctgacagctgtttatttagtatatgcagtggttttcaaagagcagtctctggagcagcagcagcagtaacagcagcggagcatctcctgagagcttgttggaaaggcagatgcccaggccccactcagacctgccaaatcagaaagcctgtgacggggtctgcagtctgagttttaataggccctccaggtgattctgatgcgctagagcatcagaaaggtaaagaggcatttctgatatatagttactcttcacagtgcttgcaggtttttgtcaagtaagtgaaaacacatgggtatgttatggaacgctttatttacagtatctcttggatgtttgatttgtaaaccacatgctaaccaggccttgattactttacaggttcatgtttattttatagaattaattctgctatgactttaagtttgcttttctttcttctgggaaacaaatgtgatttggaaggtgctgtagtttgaatgtattccccaaagttcgtgtgttggaacgtagtcccccatgcagtagtgttgggaggtggagcctaatgagtggtgattaggccaccagagttctgccctcctgaatgggttaatgttattgtgagagtgagtttggtaaaaggatgagttcagcctccttttctctctctttcacccatgcgatgccttttgccatgttacggtgcagtaagaaggccctcaccagttgcaggcccctcaaccttggacatcctagcctccagaactgtgcggaaacaaatttctgttcatcataaatgacccagtctcaggtattctgttatagcagcacaaaacagactaaaacaaatggaaaagtttaaaatctccactgactagagataaagcaaggttagcttcccagggatttcagctggaagtgaggcttataggagccattgggaaggctgagtgaacggggaacctttttgtgtaagaaagggaactctaagcctggaaattctgagcttctaatccctgggggtggcacatggggggctggacagtaagaattgatagatgtcctccttctccattttttttctctccaggacaccttacagtgttattcatttattcgtttattcattcacaatttttagaactgttgaatatgttagcagagatattatttgatagacataagtgcacccaggtcattcccaaattgcagggaaactaccaatctgtttaatttacttttgataaaagataggaggacatttttattgtttattgcttgggatctcccaaaaagaagatttctaattggttgttctttctctattactactaaatctctgaaggaagacattttaatttttttaaaaattagggtggtttatttcttgataatttttattaagagataggatctcactatgttgctcaagctggacttgaactcttgggcccaagagatcctcccgccttagcctcctgtgtagctgggactacaggtgtgtaccaccatgcctgacatagttcctgataattttgtctcagttctcatattttactggcaatatgaattcaatcttaagtaatgttaatgcatatcctatagttgtctccaaataagtagacttgatttgcatataattgaagcaacatatatttcacatacttatgcctagattcagtatctagccagcagcttggtatcctggcacttagaagatactcagtaaatatttgctgttatgacaggtttgcataacatgtctatactgtattgtttgtctaaatgaggaatttattgtctgtctaattaaagatcatcttggcagctttcagatgccatgcaaacattaaatgttgagtttagatttgcttccatcccctgtggaacctggcaagttgttttaatttctctgtgcctcagtttcctcatctgtaaaatgtaagtggaaaatgcatcatcaaaggattaaatgatttaatagatggaaacgtacatgctcaaagtgtgctcccatggagtcaacacctaaagggcagggatggtgatggcagaacccccctcattactgctgccccttggtctgtatccttctttacctgtatccttctttacctgtatccttgtctacctccttgcctgttctttttcactttaacagaatgtggatttaaaatcctagccctattttcttttttcttttcttttctcttttttttttttttttttttttttttttttgcgatggagtctcactgtgtcgcctaggctggagtgcagtggcgcgatcttggctcactgcaacctccacctcccaggttcaagcaattctcctgtctcagcctcccgagtagctgagactacaagcacatgccaccacaccaggctattttttgtatttttagtagagatggggtttcaccgtattagtcaggctgctcttgaactcctgacctcaggtgatccatccgtctcggcctctgaaagtgctgggataacaggcgtgggccaccacgcccaactctagccctattttctcttcagaatgggaaaattcttaagttatctatatggaaatacttcagtctatcaatttgggtggggaccaaattaatccttgtgtctgtatacttaaaaaactagtatgttctattgtttccagatatagccgaggtggggagaacatttggacttctgtgttgtatattttgccatcttgcaggggatcttggaagtgtcattctgaagttaccaagcattctcttatttcatttaggcttccaagttgaagttggtcgttgctgctgctgttgcttgtctaaaagcctgagggtttataatgctatctagatgggaaggagctacttgaaatgtgtttgaatctttatgcttgcttcagaatgtagagtttgacttagctaccagggtcagccaaccttgtggtcaacccagtcctgtgggagtttagaagggaggtgaggaagaggaagtacacttggtacactgggttcacctaacgtccctcaggcctcaccgcctctacaaagttaatgaaattttgtgttcataagctcagtgaagctcagctgagaggactaactggaatgttgaagccattaggaatcgaaaacctgggccgcaactcacgtgcccactttttaaaaaaattctagtacttttcatagaagatgtttgctagtaacccctctattattcctcacctccccaaaaggggaccattgtaatcagccagtcttggtccttgagattgtcacttttctgttttttgccccagtcctacacgaagcaggcttctcagggtgggatgaggagcctggtaagatagtcacatagtcagcctcatgaaatatgactccccattcacctgccccctaaactgtgcttcctcaggtaagatctagtaaggcagcccaccagagcctcgctgcatgttgaactcttaggaagtttgtccaagaaatggtagttatagagctaatacaaacatgcttttgctctcattctgttctctactaatgagttttattttccaaaaagaaacaaagatacatttatttgtaaagaatatataaggccggatatggtggctcaagcctgtaatcccagcactttgggaggctaaggcaggaggattgcttaaggccaggagttcaagaccatctgggcaacgtagcaagaccttgtttctacaaaaacaaaataaaaaatgaatatataaagataattttttcctccatgagaaccagggtcacgtgaggcccttccctgctttggcactgattctggtgatagtctcaaaagcttccttcctcagttctccagtctaatctttgctattagtttgaattggttaacaggttggaggattgtgcttgcttattcctcttcactggactctgcctgtaacttttcacattagattaggggaactctgagaaagaagtggagcttataatgtgcttctgtattgtagctttgatatctctgaaaacgtgtacctttctctgctaagcaggacaaataagacaaaccaaacagggagggacatcctcatcctgtggacatgtgaatatttctagaaggttatgcaaataatctagaaggttataatatctttttagaagttgcctttgggaagagggactgggggcaggagtgggaatgcgatttgaaatagttttcaccatatgccgtattaccctttgaaaaaataaagcaaatgtgtgttttggaaaaatatgttttgagaataatgtggacaaaatagaacagcagtaaaatccatgaggaatcaggactgtatcttttggtcaatgctgtatccccactgtctggtacataggtcaacatggcagcagtgattctgtgtaggtaatgagatattttgtgattaatattttttcttcctcaaattttcagctatacatgtttttatagttagactgtaacagttgagttggaaaaattgtaagttaccctttgctgctcaagatacaaagttctctttggctacaaactttgccttatgaaaattagtctgaaagatagatcagttattattggaaggattcagtggctatctaattttccaagtgtgtatgtgtgtacatgcatagagaatgagggacagaaatgttaagaggcccaggactctatagctgttaaactgttgtagttaataatttgtgaaaggggccaggcacagtggttcccacctgtaatcccaccactttgggaggctgaggcaggcagatcactggaggccaggagttcaagaccaacctggccaatgtagtgaaaccctgtctctattaaaaatacaaaaaatattagctgggtatggtggcatgtgcctgtaatcccagctactccggaggcttaggcaagagaatcccttgaacccaggaggtggaggttgcagtgagccgagatcatgccactgcactccagcctgggcaacagagggtaactgtctcaaaaaaaaaaaaaaaatgtgaaaagaaagtgtgtaggaagcagatctgtaaaaggtagtaatgaatcaactagtgtccatgggggaaataaaggttgtgacacgaaagtggagtgttctcttgactcacaaagtgaactctgaagagcctgtgaagaggtgaactactcatgaccattccttcattcaacaggaggtgctagatgccatgtataaggtggaatttacatagggtttatgaccaaatgccttcaggggtcaaatgtgatcacagcctgtataaaataataggaagctttggagtgtctctcagctggagaatgcatttgctgctttcgtcactcaaattggaagggaaacatttgtgagcagtgtacaggcaaaacaagatagattagtcttgtttagcatcttggaagctgccactggccccagcattatgctgtaaaatggaggtagccatggaagtaccgtgaccttagaccaatgagagacgagaagcactgtgatagcaagacctgcatctagcatctgaggacttagactgaggtgccacttactgtgtgatattgggtataagttctttgagcttttttttttttgagacggagtctcactctgtcacccaggctggagtgtgcagtggcgcgatcttggctcactgcagtctccgcctcccgtgttcaagcgattcttctgcctcagcctcccaagtagctgggactacaggcgcatgccaccacgcgtggctaatttttgtattactagtagggacagggtttcatcatattggccaggctggtctcaaactcctgacctcgtgatccgcccacctcggcttcccaaagtcctgggattacaggtgtgagccaacacacccggcctgagctcttctttatttttggagacagggatcttactctatcacccaggctggagtgcagtgacatcatcacagctcactgcagcctccagctcctgggctcaagtgatcctcctacctcagccttctgagtagatgggaccataggcatgcaccgctatgcccagctaattaaaaaaaatttttttttgtagaaacagtcttgccatgttgcccaggctggtctgagcttctttctacatttgaaaagtgggtttatgtttaccctgtctcaaaagagggtgaggtatgggagattgctctgaaaattgttcaagtgtgtgtgtgtgtctacagtggggagggatttaccacttatttgaataattctttggtgaagtcttattagtgttgaaacgggtttatcatttaatcattacctcaaaggcaatgctaccttagctttgtgacatatgttttaaaataaataaattaattatttttgagatgaagtcttgctctgtcacccaggctggagtacagtggcgggatctctgcttactgcaatctccgcctcccgggttcaagtgattctcctgcctcagcctcctgagtagccgaggttacaggcgtctgctaccatgctgagttttatatttttagtggagacaaggtttcaccatgttggccaggcaggtctcgaactccttacctcaagtgatccacccaccttggcctcccaaagtgctgggattacaggtgtaagccaccgcgcctggcctatttatttattttttgagacagggtctggctgtgtcacaggctggagttcagtggtgcgatcttggctcactgcaacctccgcctcctgggcttgggccattctcccactttagtcttccaaatagctgggattacaggtgtatgccactatgcccagctaatttttgtatttttagtaggagatggggtttcgccatgttgcccaggctggtcttgaactcctgagctcaagtgatccgcctccctcagcctcctaaagtgctgggattacaggcatgaaccattgtgcctggctgatatgtgcttttttttgaaacggtgtttgaaatgagattttcctggctgggcgcggtggctcacacctgtaatcccagcactttgggaggccgaggcaggcagatcatgaggtcaggagttcaagaccagcctgaccaacatggtgaacccctgtctctactaaaaataaaaaaattagctgggcatggtggcgggcacctgtaatcccagctactcaggaggctgaggcaggagaatcacttgaacgtgggaggcggaggttgcagtgagctgagattgcgccattgcatcccagcctgggtgacagagagagactccgtctcaaaaaaaaaaaaaaaaaaaagattttcctttctccttcaacttgaaaggcaacattttgcattttggtagcactatctttgagacgtaacttttttgaatcctaatatatgatttttagccagattcttccttgtccatcttagcatttcttttactacgaagtgtgaattttgaaaacagaagttaatagtaagaatctctgaattgaggctggacccggtggctcacgcttataatcccagtactttgggaggcagagacgggaggattgcttgagccatggagtttgaggccagcctgggcaatgtcaggagactctgtttctacaaaaaatctttaaaaattagctgtactctagcctgggtcacagagtgagactccatctcgaaaaaaaaaaaaaaaatctctaaattgaaaagactttaagagtagtttctttgagacccatgctgtaggaaaatatttcatcaagggaaactactctgcgagggaggggacatctgtatttttaacactggaggataaagcttgggaaggcaattctgtctcctaatctgatgacagagatcctctctttataaagcttatggcttattctcaggaaaagtaggggggtgagtgtggaagatagtgtggctggggtcacttaatgcttgaaaaggtttcctagggctgctgggtgtcaacagcgggccagcctcctaggttgattacacgtccttgactattatccacgcccttgactattatccacaccagcataatatcccatcttggattagagatcatctaattcatagttgtcaacctggctacccactgaaaactccaggaaagctttaccaagaaaatgtgtgttccctggatattgtcactatcctctgtttatttggggatagaatattctggcataggtgtttttattttaaactttatttatttatttatttgacggggtctggctctgttttctaggctggagtacattggcatgatattggctcacttcagcctcaaactcctgggctcaagctatgctcccaagtagctaggactacaggcatgcacaccacacctggctaattaaaaaaatattttttggttgagacagggtctcactagggttttttgttttgttttgttttgttttatgtagtctcactctgttgcccaggctggagtacagtggcatggtctcagctcactgcaacctccgcctcccaagttcaagcaattctcctgcctcagcctcccaagtagctggaattgcagacacatgccaccacacctggctaattttttgtatttttagtagatacagggtttcaccacgttggccaggctggtctcgaactcctgatctcaagtgatccccccacctcggcctcctaaagtgctgagattacaggtgtgagctaccatgcctgtcctcactagggtattctttttctttttcttttcttttctttttttttttttgtgttttaaacactttcaagctctcaaaacctcaaagaaggatacaatgaacatctattcccttcacttagctttaccacctgttgacatcttgccacaccattccatctacagacattgggatggctcacccctaaatccttcagcacacatctcacatactgagaaagacattcttctctccagcttcatcctcagtgttaccattactgtgtgttcagttccattgttcaatataaattccacactatgatttcccctgctatgctttatagccatgttttaggacccaggtaagtttctcgcattgcctttggctgttattcctcaaggccttccccagcctggaagagtggtctcacctccctctcaatgcaatgaccctgaatcctctgaggagtccaggcctgtttcctccaggtgcatcacatcaggggctacagtgtccaccctcccactactggtgatgaatagatatttttaaaaacctccctaggagattccaatgtgcagccaaggtttgaattcattgaattaattaaatccaccctactttatttgtatgtgtttttttttgtgctaaaatacacataaaattatcattcttaccatttttcagtggacagttttgtggtattaagtacattcacattgttgtataaccatcatcacgatctatctttggaactttttttttttttttttttgagacagagtctcacactgtcacccaggctggagtgcactggcatgatctcggctcactgcaatctccgcctcccgggttcaagtgattctcctgcctcagcctcccaagtagctgggattacaggtgcctgccaccacgcccggctaattttttggatttttagtatagatggggtttcactatgttggccaggctggtctcgaactcttgaccttgtgatccgcccaccttggcctcccaaagggctgggattacaggcgtgagccaccgtgcccagcctctggaacttttttatcttcccaaactgaaactccatacacattaaataataactcccattctctctcctcccagcactggataaccaccattctactttccatttctatgaatttgactgctccaagtacctcatgtaaggggaattatacagtatttggtcttttatgtctggcttgtttcacttagcatgtcttcagggttcaaccatgtcatagcatgtatccgtacttcctttttaaggctgaataatatcccattgtaggtacaggccacattttatttatccattcattcattgattgatacttgggttatttccaccttttggctattgtgagtgctgctacagcgagcatgggtgtacaaatatctgtttgagcctttgctttagttttgggtatatacccagaagtgggattgccagatcatatggtaattctgtttaattttttgaggaattgtatacctatcactttttaatggagtgaattgaagaacacttcaaagaatgaagtatccatgacttgaaggaagaagccaattagaatgccagcctttaggctcctgtttggattacctcctgggaggtcatgtgtaaattcatcttttcttcacacgagataaagagcaatgggtataaagtctagctgtggcagctgggtgcagtggctcatgcctgtaatccccgcactttgggaagctgaggcaggaggatcgcttgaggccaggagttggagatcagcctgggcaacatggcaaaaccctatcctctgcaaaaaaaatacaaaaattagctggtcgtggtggtgtgtgtctgtagtcccagctacttgggaagctgagatgggaggatcacttgagccccggaagttaaggctgcagtgagccatgatagtgtcactgcactccagcctgggtgacagagtgagaccctgtctcataaaaaaaataggtgtggcaaaatttacttctttgtgacttcaggtgtgacctcagatatgcaggacaagggtcacagtttttcatttacattaatcatgactttttagaatttttaaagtttttgattggtgacttaaatagtgcatagacaacaagttgcctttgacctctataaatagtgtaaaacaaagtaacaggctgcctcttggggcatatgggattttcaaaatagaatattgttttgttaacctggctcatccaaatactgtgcgatcttgaacaaggtcttaacttccctagctcatgttgtttagctataaaatggggataataatggtaatcagaatgaaataagctaatctatgtgcttggtgcctgacacatagaaagcattcattcagtgcaagctattaatataatatttcccattgattttaaaggtgtttagacaattccaatacaccagaaactgatatttttaaatgagttattactcttttacaggaggtggcatctatttgactgtcttgagatgagactggcctgggggctctagaatggtggtgcttaactggagcaaaaggtggcaggagcatgtgagagctctagcataactgtggccttaaagtaagcagacgctatgtatttcctaagggtgagtgttgataatttttatagattgctgaggccacagggtccagattaagcaagtgtgttccgaggagtctgacttcactgtgctttgactgaggtagatccaggactcagttggcggctgtttttgaaggctgatcattcttccactccttcattggaaattagccaagaattataaaaacaacagtttaactccatgcaaccaagtggttgtctcataatgattagtttggagcttgtgctaagtactctgtgtggagttcccaggattatttaacaagagaaaatgttggctctgcaggagagcctagtaaattttgaaacgcagacaatcctacttcagtggaaaaatcctgatcttaaccccgagtctctggtctgtctctggctcccttgtgcaatctggggggattgtgcttcatgtctggtagaagaggacaggtctatgagaaggaggcatgtacacacagctctaagaagtggggaccggcttctacactttctgccaggttaatctcaaatggtgcagataataacaaacacatatgatgcttctatatgccaggtgctgttttaagcactttgtaggaatcgcccaatttaatccttgtaactaaactctgaggttggtaatgttatccccattttataggtgggaaaactgaggtgcagaaacattaagtaacttgcccaaggtacagctagtaagtggcagaatgaaccaggcaatgctacgccaggctttgtgcctgtcatgcctgttgaatacaagctagaaagacagcttttgggtacttggtactctgtcttctgagtaaaggatttatccattttattagtttcctgtttgttcctgctataaaaaattaccactaatcaactcagtatagccattaaatttgggaaaaagaagaattttagacattctaaattttttggcacagtgactgtctaatcatgaacagcgatgtgcattgccagggaagaagctgtgagttactggggttggctggtacctgctattaaaatggtgctggtacccgctattaaaatggtgcttggtcgaccgggcttggtggctcatgcctgtaatcccagcactttggcaggcctaggcgggtggatcacgagatcaggagttcaagaccagcctggccaaggtggtgaaaccccgtttctactaaaaatacaaaaattagtcaggcacagtggcgggagcctgtaatcccagctacttgggaggctgaggcaggagaatcgcttgaacctaggaggcggagtttgcagtgagctgagatcgtgccactgcactctagcctgggcgatagagcaagacttcatctcaaaaaaggagaaatagtgcttggtcatcatcaaagctgagaagtcatcacaaaaacagatgaaagaagaaagagtgggaagagtgcagaagtagcagatatgcaagaaaggatttagaagcatcaaaaggcacatgaagccatggtgggcactgagctagtgagagagggcacagtaagagtatcactgtttagaagaaagtaactcatgatgataatttacactgtctctcagtgacttaaagtgtattcagcacattctgaatagggaaactgggaagcgtggaatcctttatagagcagttttctaccacgtttacattgtagcacctgtaggtttagcgaacagttaaatggaaaataggctcatttagaagctctttaatcaggcaggatggcagggatatatattgttcttaaaataatttctatagcaacaggactttctgaaatatatccataactcagttaggaatatccactttctattttttgccttgggtaatcaaaaacagagacccaaatttgggactgaactgtagaattcgtgaggggcttcaatattgttttcagtgtgtttattcccccctgctttcattgtccttgtctacttttattttccctttacccaattttaagatttcttttatttataaacctttttttccctaacagatcttttttatttttattttattttattttttgagacgaagttttgctcattgcccaggctggagtgcaatggcacgatcttggctcactacaacctccgcctccctggttcaagtgattctcctgcctcagcctcctaagtagctgggattacaggcatgtgccaccatgcccggctcattttgtatttttagtagaggtggggtttcaccatgttggtcaggctggtctcgaactcctaatccacctgcctagtcctcccaaagtgctggtattacaggcatgagccaccacgcccggccctaacagatctatttttgtaaacctcctcaaatatttttaggaaaaacatgagatataattaaagtgttcattggacaagtgagtggttggactcctctctgccctcagggagctgattttctgggaggcgacatggcccactggcccagagctgggctctggctctgtcatttgctaatgcttagctctggtttcctctcctgtgacctgaagtaatgaaattgtagtacctgcctgatggcattattaggacaaaatggaacaacaaatataaagcactctcacagagagagtgcccagtgagagaaggaggaagcattctgtgaagaggagacaggctgtgcccaggcctggccttaatgcatgcatgcacgcaggattgattagggaaaggagagcacggtgcatggagggtctggactgccatgggaggcaagtattctggagacactgaggaggcattcacagtcagacctttcctgcttctgcctcctcagctttctttatcttcctgcaggactctaagcctctgcctttcttgctttctttccctgcattcgcttaatccatctggagactatgctagctcagttaagttggggggctgccctctctagtggttccagcaggactgaggatcggttcaacactcataacactggtgaccactattctgggagacagattcttcattaaaattttattgcttggtttccttttttcttctccatcctctttatttactaccctctgttatacataaacttttgaagtctgaatagcaaacagctgttaatgttgccattgcagaaccacggacacaacttaaaataaactgattggtttataatgacatggagaaatgcttattcaggaagcaaaaaggcaagatacactgtagggaagttagaacctaaatagtacggggaaaggactgaaaggaaatgtgtcaaattgttaacagttgttttagatagaatgatgtttcctgttctgtagtcttcatttttcccagagagacttgtaagtattataagcaaaagaaaaaaaaacccacattagttctcatattattccttctgattatgagagatgaagttctcatctgctcggatttgactagtgtgggctaataggtcccaggtagacattgttgatgggatgaattgccaataatcattttgctggccttgcttttcggttaccttttacctgagcctctgagctccataacaccactgtgcctcatgggtcagtgcgtgcataccacacagaaatgtgagttgttcatgcatgctggggttagaaactggaggatagactcagtctgaagtggaaattcttgggtactaacttcatggatcagtttcagagcaggttttcccatggtctgtgccagtatcctcagtcttgatgctctcaagtcaacgggattagaatgtgtttgcgcagttctgggtttcccttcatcggcatccagtcattttcagtgagcagaattgcggtcagctggcacatcaccagcaagggccaaattagacataattgcacatcagtttcacgttaaggtctgtggcttaatgtgctctgcaaaagcatgccaggcctggagctttgttctccctgggaacagcgtgccccagaagaaaggttacagtataaatcatcatccaaacctagacacctaggaaagggggattctgttagtttttccaaggcaaccatataaattgtgccagccctgggcaagccaggacttatggtcaccctgcccataaggatgggtctgtgcaatgacattcactttcctagacagcctttacagcaacctttggagcagaagggaaaccaaacagttggagaggatgccacagcattccagaaaaggggaagccgggttccttttcaggaaagttgagctaaaaatagaacatcaccattcaacagttgctcgagctcttcaaacactggggcttgtgccattgttccttttctttgcatttcttatgagtcctggctccttttgctttgtgttgtaaaggaactggtctatgtgccgagtctgctgggaagcagcccctttaatacacgaagggcgctggacgagaggatcactaaggccccttccagctctcacagcccatgattttataataggtaacctaaggcctgtgctgcatgggtaatgaggaaggacaagtaggggcccttcttgatgaaaggacagggcccctgcccctccatccttggctgtcacacactcaatggcaggctcttctctgagccaagcggggaaaaaccatggagggtgtgtgtgtgtgtgtgtgtgtgtgtgtgtgagtgtgtgcaggactttactgaaaaatgagttgcatagtggagtgatcagtacataatgggtggtgggcactgagagagaagagaaaataacattagagttaatcctgtaggtcagggtttctcagcctcagcactgctgatgtttaggactggacaattcttggttgtggggtgctgacttgtgcattgtaggatgtttagtatcatccctgacacactcaattccagttgcagtccccttcacctgtgacaacacaaaatgtttccagacattgccacatgtccccggttaagaatcactgttataaataaagaaacaaaattgttttctggacatttctttttgtgaagctgtgtgttgcctggccaagctcccaccttaagcttttataataccatttactggaccaattagtgttgtgacggtgggtggtgatttaaaatgaaataccctcactttcatgctcttggatttggctttgaaataaagtgagctgagctctcccccctcccctttcaagagtgcatgaataatgaggtctttctgccgggaataggattatgcttgttcccacaacttaaaactattttttcaaaatttctactgtgactagcatcctaggttttatcctgacagaaacgttccattttaaatgagggttccctagaacagtgcttcccacacttgaatgcgcgtgtgtcatgtgaggatttggtgaaattgcagattctgttcccgcaggtctgggctgggccccgagactgcatgtgtaacaagctcccaggtgatgccggcactgcaggtctccaggccacatttagtagtgaggctctgctacggaccagttcttgacataaaagaaaagttggcacatatgtccaggaggatgatgaaaggctctgagcgggggcagcataagctttcagcaatctgttgtgtgcggggctgctcgcagacccttctctgtgctggaggtgagtccctgagcccgtctgcagccttgcaggctgtcaagcagtgggaggaccaatgcctgcagttccttacctggcactgaggggagcattttaacaggacagcctgagacagatggctgcaccctctgaatgggcactgaaggggcaaactggccccagagaggcagcagcttggactgttagactctgagctatttggtggctccctgggtgtggtttgagcagagactcacagaggagcgccagcccctcagaagggctttggcctgcctttctgcttgcccagctctgcggggtgatgggcagccagacaccttctttcctagctcagtgctgcccttgttaccctgaagcctttgttgctatgggtctgctgggtacctgggaagggagaaggagtagggtatggtattgggcaccacgtgaagtgagtaaaatgtttaaatctggtaatgcaaaggaagatggggagcccaggaacccactgttctgcgccaggagtttgctttgaatccttttttctttttttttttttttttgagatggagttctgctcttgttgcccaggctggagtgcaatggcgcaatctctgcaacctccacctcacgaattcaagtgattctgctacctcagcttcccaagtagctgggattacaggtgtgcgccaccacacccagctaattttgcattttttttagtagagacggggtttcaccatgttggtcaggttggtctcaaactcctgacctcaagtgatccacccgtctcagcctcccaaagtgctgggattacaggactgagtcaccgtgactaccctgaatcttaatctgtaagtgggcagcgtctttccattgcttactaaaccaacttacttaaaaaaaaaaaaggtttctcagccaggtgtggtggctcatgtctgtaatcccagcactgtgggagaccaaggcaggcagatcacctgaggtcaggagttcgagaccaggctggccaacatggtgaaaccccacctctgctaaaaatacataaattagccaggcgtgatgacacagctactcgggaggctgaggcaggagaattgcttgaacctgggagacagaggtttcagtgagccaagattgtgccattgtactagagcccgagtgacagcgagactctgtctcaaaaaaaaaaaaaaattctagaagtacattgctttcctagaaaaacatctgaaatgaaaagtgattccttccattgagaagtaggtcatgtatgttttctcttatagatactttttgaccttattacccaaatataatcattttgtatacttaaggcatttttctttttagtttttattcctgtttttctctttttaaaaatatatccatgttaggctgggcgtggtggctcacacctgtaatcccagcactttgggaggctgaggtgggcagatcacgaggtccggagatcgagactatcctggctaacacggtgaaaccccatctctactaaaaatacaaaaaattagccaggcgtggtggtgggtgcctgtagtcccagctacttggggggctgaggcaggagaatggtgtgaacccgggaggcggagcttgcagtgagccaagatcgcaccattgcactccagcctgggcgacagagcgagactctgtctcaaaaaaaaatttatatatatatatatgtatatttatatatatacatatataaatttatatatatacatatatgtatatatatatgttaaaattagttaacattcccatcaccttgatgaagggtgttaaagtaaacttgtgctattcataattctttgaaattagaagaacatcaatctatgaaagtctttgtgggagaactgaagtccagagatcctgcccaaaccttcaatcccaagttcactaaggatttgcatttgtattccagctgaatgaaaaggagacacagacacacacacacacacacacacacacacacacacgactatttcatttgtataggatttaggacattttttagttttctcacagcatccatctaggtagagagagtagatatctgtagcctgtgggtggggacaggagttccagtgatttaaagactgatttgaggtcctagtgcagccctcagattccttggacttgtctttatagctggaagtaataggatttgaggtgtgaaaaatgttacctgcctgaattagccaggcagacctatatatgtggttcagttacatagcgctctgtgacaaatcacctcaaaacttagtggaataaaaccaccaccatcttatttgcacagattctttgggtcaggaatccagacagggcacagtgggaatggctgtctctgctccatttactggaccaattaacgagctccagctgggaagactgaaactgctgggggctggaatcatctggaagcttctccacctatatgcctggtacctggggtgggatgactcgaaggctggactcagctggggctgtttaccagagcatctgcgagttgacccttcatggagctcaggcttcttgcagcatggcagctggcttcccaagtgggagggttccaagagtgagcatctccacagaacaaatgttccaagagaccacgtggaagctgcatggatttttataacttagctttggaagtcagataacagcatttctgccactctttcttggtagaagctattgcacgtctccccagattcaaggagaagggacccacctctcactggaaggactaaaaaaattcacagccacgtaaacagaaaaagcacataagccatttcatgctacaccatggtgctaattcaatgaaagattagcttgagtagaagtcaggaaagctatatcaagaatgagttaattgtaaatgggggaaaaagcatgaacagtgtatattgtgaagaattaatgaaaataattgcgttcagtagcaaaattcaagttaacctaaatgcctagcaattggggagtagttcaaataaattataaataaaatatttatattaggaatatgatgcagactttaaaaagaatgaggtagctctatatgtaattatataagaatatgtccaagatctgttaagtgaaaagattgtttacagaaaaacatgtatgcaatgattcatgagtattttatcttaacgtgtacatatatatgtaaaaattcaggaaatagtcttaaaaattgcattaaattgttagtggatttctactgtagatgagagtaggacttgggtgggtaataggaaggagaacccacttctcactctatagttctatgctgtttaaatttttagatgtattacgttttcctatattgctcttatgatatgaattgctatgtgagattttaacttttaaaatacattaaatttaatttataaatataaaaatataaaatgtttcatatttttataaaatgtaaagtttaatttagttaatttggtaaacatttttcttcctgggactgttactgaactttactttcctagtattttattatatgaattggtacagtaggtgtggcatgggcacagatgggcactagtctgtttggcatgctttgtttggcatgctttgtagttgcgagagaaatttaagaatgccagtcttggccgggcacggtggctcatgcctgtaatcccaacattttgggaggccaagccgggcggatcatgaggtcaagagattgagaccatcctggccaacatggtgaaaccccagctctactaaaaatataaaaattagccaagcgtggtagcgcttgcctgtagtcccagctactcaggaagctgaagcagaaaaattgcttgaacctgggaggcggagattgcagtgagccgagatcgcaccactgcactccagcctggcgacagagactctgtatcaaaaaaaaaaaaaaaaaaggaatgccagtcttactgttttttgttcctcttactgctcaggcagtctcctcagtggcagcagttcctggaatgtgtggtgattccaaatgatctttttataatggttttaatagaaattaagggtagacatactcatgttgggttgagccacttatgcttgtattatctcccaaatggaattaactatattcataatatagttaattatagataataatcaaattaaggaaatttggtgtcattagaaaagatttatgactttaatggaattgactgatctttctttcttctttttttttttttttgagatggagtcttgctctgtcacccaggctggagttcagtggctggatctcagctcactgcatcctctccctccaggattaaaaaatttttgtgcctcagcctcccaaatagctgggattacaggcatgcaccaccacgccaggctaatttttgtgctttgaatagagatggggttttaccctgttggccaggctggtctcgaactcctgacctcaggtgatccacccacctcagcttcgcaaagttctgggattataggcatgagccaccatgctcagcccaggctggtctatttctgagctaatcttctggggtgggttttttggagcatcacatacccctcaagctaatagaacaggatagaagccaagatggagatctagagctacattttaaaggtgccagtcctctacttacttcctgtgttgtatggtaacctgatcatgcctcatttttcaaacaattatgttatttaaattagtgtcagacaagaagtagtaagaataacttaaacggtgccagggactgagctgtgctctggctgggcaatgagttagctgatacttcctacctgtataacatttatggtttagtaggatagacagaaacataaaataagtgattatgagaagatcggctcatcacaactttgagagatacacctggctgcatactctctgtttgccctttctgatccaccatgctctgtgccctgggaggcagaccattatggatcacatatggggccccttgccctgtggcttttaggtatttatttcccctgctccctccttccctcagcttcctcacatttgtaaaatgggatattatttaagtagtcagggtccaggcaggaaagaaatggtactcaaaacagtctaattgcaaagagtttaatgacagaaatttcacaaagatgtgaacaaggtaagggaaactagcaagaattgtggggtacctgggaggtaccccaaatacttgcagatacttttctctcacgtttactctgatggttatttcttttgctgtgcagatgctttttagtttagttgggttccatttatttgtttttggcacatttgcttttagggtcttagtcataaattctttgcctaggccaatgtccagaagagtttttcctgggttttattctagaacttttatggttttaggtcttagatttaagtctttgatccaaggcttaaggctctgggtcattggtggtgctatgttcctctgctgaaagccacagctcccatagggtggccctctcttacagctgttgttgcagctaaattcttgctgaattctggcaactaatcctcctcctcaaaaacacttaaacaaacaaacaaaaatgcatataaactctcccaccccttcagacgtaggggaggtgatagctttgctgttgctagcctcctaagtacccaacaattcttgctagtttcccttaccttattcatgtctttgtaaaatttctgtcattaaactctttgtaattagactttttataattagactttgttttgagtacaatttttttcctgcctgaaccctgactacttagataatatcccattttacaaatgtcaggaagttgaggcgtagagatcggtgaatatcagaactaggattcaaattcagattattttatgtcacggctgattcttaacttcagtgttttcctatttgtcacatccaaggaattctcatagtcatctttacattgagaagaaaccctagggaaaagtttcttacctgtcagatacagctatgaagttatgaggctataaaacaaactagctcttaaatatttcaataaataacatccttccaatcaactcctgtggttcagagtttttcgttactttcttttagaattgccatcagattcatattataagccaggaaggaaaaaataatctaaaagtaatcaaaccttcaatttgccaccgtattctctaggcttggttcaggttgactactggttgtttgcaaacacctgatccacttttgaggaccaagtttaaggatatatttaaaatttttaaagaaatttcaatagctttgggggtacaagggtttttggtatgtggatgaattgtatagtggtgaattctgagatttttagtgtgcttgtcacctgagtagtgtacattgtgcccgatacatagttttatatccctatttcccctcccaccctcctctttctgagtctccaaagtccattatgccactctgtatgcctttgcatacccatagcttagctcccagttataagtgagaatgtaacggtgtttgattttccattcctgagttacttcacttagaacaatgacctccagctccatccaagttgctgcaaaagacattatttcattctttttttatgattgactagtattccatagtatatatagtccatattttctttatccacttattggtcaatgggcacttagattggtcccatatctttgcaattgtgaattgtgaaaaagacacctgcattaaacatacacatgcaggtgtcttttttatataatgacttcttttcctttgggtagatacccagtagtgggattactggattgaatggtagatctacttttagttctttaagaaatcttcatagtgtttttcatagaggttgtactaatttacattctcaccagcagcgtataagcattcccttttcaccacatccgtaacaacatctattgttttttgatttttattagtagccattttggctggagtaaggtggtatctcattgtggttttaatttgcagttccctgattagtgatgttgagcattttttcatgtgtttgttggccatttttatattttcttttgagaaatgtctacgcatgtcatttgctcattttttgatgggattcttttttttttctttttttttgctgatttgagttccttgtagattctggttattagacctttgttgtatgcatagtttgcaaatattttctcccattctgtgggttatctgtttactctgctggttatttcttttgctgtgcagaagctttttagtttagttaggtcccatttatttgtttttgtcacatttgcttttagggtattagtcataaattctttgcctaggccaatgttcaaaagagtttttcctgggttttctcctataatttttatggtttcaggtcttagatttaagtctttgagccatcttgagttaatttttgtatacaatgagagggatccagtttcattcttctacatgtggctatccagtttccccagttccgattattaaatagggtatccttttccagtttatgtttttgtatgttttgtcaaagatcacttggttgaatttggctttgagttctttacttatgttccattggtctgtgtatctacttttataccagtaccatgctattttggtaactatagccttgcagtataatttgaagtcagttaatgtgatacctccagatttgttctttttgcttaggattgctttgactattcaggctgttttttggttccatatgaactttaggatttttttttctagtcatgtgaaaatgatgttggtattttgaaaagaattgcattgaatttgtagattgctttaggcagtatggtcattttcacaatgttgattcttccaatgcataagcacaggatatgtttacgtttgcttgtatcatctgtgatttctttcagcagtgttttgtagttttccttgtagtgatctttcacctccttagttaactatattcttgggtttgggtttttgtttgtttgtttgtttgttttttgttttggtttttttggcagctattgtaaaagggattgagctcttgatttgattcttagcttggtcattgttggtgtatagcagtgctattgatttgtgtacattgattttataacctgagactttactgaacgcatttttcaaatctagaagtcttttggaggagtcttaagttttctagataaatgatcatatcatcagcaaacaatgataatttgactttatcttttccaatttggatgccctttatttctttctcttgccttattgctatgtctagaacttccaatagtatgttgaatagaagtggtgaaagtgggcatccctgtcttgttccagtactcagggggaatgctttcaacttttccccattcaatataatgttggcttgtgggtttgtcatatatgacttttattattttgagatatatcccttctatgcctgatttgttgagggtttttatcataaaagaatgctaggttttatcagatgctttttctgcatctattgagatgatcatatatatatatatatatatatatatatatatatatatatattttttttttttttttttttttttttttttttgagacagagtcttgttctgttgccaggctggagtgcagtggcgcaatctcggctcactgcaacctctgcctcccaggttcaagtgattcttctgcctcagcctcctgagtagctaggactacaggtgtgtgccaccatgcccagctaatttggtatttttagtagagatggggtttcaccatgttggccaggatggtctcgatcttttggcctcgtgatccacctgcctcggcctcccaaagtgttgggattacaggcatgagccaccgtgcctggccaatcgtatggttttgtatttaattctgtttatgtgatgtattgacttatgtatgttaaacatacatttatatgtttatgttatacatacatacatacaaatgtatacatacatttatatgtatatgttaaacatacattatatgttatgcatacatttattggcttatgtatgttaaaccatccctgcattcctgggttgaagccccttgattatggtggtgtattatcttttttttttcttaagacagagccttgttctgccacccaggctggagtgcaatggcgcaatctcgactcactgcaacctctgccttttgggttcaagtgattcccatgtctcagcctcctgagtagctgagattacaggcacccaccaccatgcccagctaattttttatatttttagtagagatggggttttgccacattgcctaggttggtctcaaactcctgagctcaggcaatctgcccacctcagcctcccaaagtgctaggattataggcgtgagccaccatgcccagcctatctttttaaaaaatttttattttattttattttaagttctgggatatatgtgtgggatgtgcaggtttattacataggtaaaagtgtgccatggtggtttgctacacctatcaacccatcacctaggtattaagccccaaaggcattagctatttatcctgataaatagctcccccgctcccctcccacaggccccaccgtgtgttgttccccttcctgtgtccatgtggtttcattgttcagctcccacttacaagtgagaacgtgtggtgtttggttttttgttcctgtgttagtttgctgaggataatggcttccagctccatccatgtccctgcaaaggacatagtctcattcctttttatggctgcatagtattccatggtgtatatttaccacattttctttatccagtctatcatgggtgggcatttgggttgattccatgtctttgctattgtaaatagtgctgtaatgaacatacacatgcatacatctttataacagaatgatttatattcttttggatatatacccagtaatgggattgctgggtcaaatggtattatctttttgatgtgccgttggatttggtttgctagtattttgttgaagatttttgcatctatattcatcaggtatattggtctgtagttttttttttttttttttttttgtttgtttttttttttgtttttttattatgtccttttctggctttggtatcagggtgatactagctttcatagaatgagttagggaggattcctctttctaaatctttagaaatagtttcagtaggattggaatcaattcttctttgaatgtctggtcgagttcagctgtaatccatctggccctgggctcttttttctttggcaggtttaaaattattgattcaatctcagttcttgttattggtcttttcaggatttctgtctcttcctgattcaagctaggaaggttgtatgtttccaggaattcatccatttcctctagattttttagtttgtgtgcacagaggagttcatagtattctcaagtgatcctttgtatttctgtggtgttggttgttatgggcttcattttcatttttttctttttttgagatggagtgtcgctgtgttgtccaggctggagtgccatgtcatgatcttggctcactgcaacctccacctcccaggttcaagcaattctcctgcttcagcctcccgagcagctgggattataggcgtgcaccaccatacccggctaatttttgtatttttagcagagatggactttcaccatgttggccaggatggtctcaaactcctgacttcaggtgatctacccaccttggcctcccaaagtgctgtgattgcaggcaagagccaccgtgcctggccttcattttcatttctaattgagtttgtttgaatcttctctctcattttcttggttagtttagcaaatgatttatcaattttgcttatcttttcaatgaaataactttttgtttcactgacgttttgtattttttgtttaaatttcatttagttctgctctaatcttttatttatttattattttctagttttagctttgtgtttgttcgtgtttctgtagttccttgaggtgttatgttgtcaatttgtgatctttccgattttatcttagcactgcttttgctgtatcccagaggctttgataacttgtgtcattattatcattcatttcaaagaatttttaagtttccatcttgatttcattgttaacctaaaaatcattctggagcagattaatttccatgtatttgtatagttttgaaggttacttttggagttgatttctagttgtattccactgtggtctgagaagatacttaatacaattgtttctttaattttactgagacttgtggactatcatatggtctatcttggagaatgtttcatgtgttgagaagaatgtatattctgcagttcttgggtagaatgttttgtaaatatctgttaggttcatttgttctagagtgtggtttaagtccagtgttcctttgttgactttctgctttgatgatctgtctagtgctatcagtggagtactgaagtcccgtactattattgtgttgctgtctatctatttcttaggtccagtaataatagttttatgaagctgggagctccagagttaggtgcacatatgtttaggtggtaatatcttcttgttggattgatccttttgttattatatagtgaccttctttgtctttttttttcttttttactgttgttgttttaaagtatgttttttctgatataagaatagctactcttgctctcttttggtttccatttgcgtggaatacctttttcactcctttacattgagtttatttgagtccctgtatgttagataagtcttttgaagaaagcagatatttggcttgccttgttttaatccattttgccaatctatatcttttaagtggagcatttaggctatttatgttcaatgttaatattgaaatgtgaggtactgttccaatcattgtgctgattgttacctagatacttggttttctttgttatattagtgttttataggccatgtgagttttatgctttcaagagtttttattctgctgcatattgaatttttgtttcaagatttataactccttttagcatttcttgtggggttggtctggttgtgacaaactcactcagcatttgcttgtctggaaaagactttatttctccttcatttatgaagcttagtttagctggataccaaattcttggctgacagttattctgcttgaggctaaagataggaccccagtcccttctagcttgtaagatttctgctgaagttaaggggacatttaaaagaaatacattttctgctgggtgtgttggttcatgcctgtaatcctagcactttgggaggctgaggtgagaggattgcttgaggccaagagttcaagacttagctggccaacatagtgagatcctttctctttttaaaagcattttcattttttataattatatatttttaaaagtaaaattttaaaaatacattaattgagttgaaggacattccaaaagaggcacctaaagatgtgctcagtgatggctgccaagttgaaatgagcatagagcttctagggactattttgaaagataggatatttatttctgtgtgtgatctcttgacttacaaataccagaacttactcatgttacctgtgtctcacctcagtgcatcctgggtgtgtattaatttctttgacctgcagaagaactctaggctggccaagttgacagtgattgagagcatacagcccattattgccatctaaccagagatggcttgagacagcatagcctagtaagtagttaagagtagggccctggccgggtgcagtgactcagtaatcccagcactatgggaggctgaggcggacggatcatgaagtcaggagtttgagaccagcctgaccaacatggcgaaacctgtccctactaaaaatacaaaaattagccaggcgtggtggcggatgcctgtgatccctgctactcgggaggttgaggcaggagaattgcttgaacccaggaggtgaaggttgcagtgagccgagttcgtaccattgcacttcagcctgggcaacatgagcaagactcagtctcaaaaaaaaaaaaaaaggagtagggccctgaagccagactgcattgatgacaatctaggccctacaaattactgctcagtgtccttgtgctctgtgtcttggtttcctcatttcgtgagcggaaataatagtactttattcacacaggttttgtgaggagttaattagttaatttgtgtaaagggtttaagagaatgtctagcacaactgtaagtgttcagcagtggttagcatgctttttattgctgtcattatcttgacagtctgagatgcccgtttattcttcctgccactgtgtaatcacattcatctataagtcttgtctgtcacattttagtaaactcttttttacttcccggaaggaatcaggaattaactacctaaagtacctacttttgaagaggttgtgtctaagtcacgggatatgagaaaaagaaccaaaagaaaaagaaggaattacgagcctggaagaaagcgagcatgttggtaagagaaggtacaactgtaataatgctacttcttataaagccagtggcagggttcgtgaatctcagcggtatgtttgggctgattttcacttctggttctgttcccattcgagcactacctttgatctcctatgctgttaatacctgttacttttctaccttttggttaactttgtagactgaactgttgcagatgaagaatcactcttgcatcaggcatgtaaaagatatcaaaactaaagaaattttgccttccttaagaaagcaagaatgagaaatccccctgtgccatccataaagagggcattcaaagcctgagtgttgagtaggagttacagcagaatggcacatgtggaatgaagttcaggcctttgaggactaggaaaatggtactcagcttttctcgtattaatgcctggaagcaggaagagctgttctacctataaaatgggggttggagggatcctacccattagcgagggaatagccatgggaggaaagaaaggaactggcaagaaaacagggacccaaagcctgaatcactcatagatgaagtagctgatttcttatctatgtgatcttatccccccatcagatgagacattaacacagagttgtctgaggcaggtggagaaggttaagggagctataaaagggtatcgggctacagtgctttcatagagaatatatatgcattctgtttctccatttttctttggaggatttaattcttttcttcctatctttccaattaaaatgaaaacctatggtatgatttattacaagaagctttacttaacttctaatagtctgatctcatttccttgaataaaaatgacatcacagtaaaactagattataacatttttaggctttgacataatacagacctatgaattgacttaacccactgaatagttatagaagtgaataactaagctgtctgtgtaatggggagggaaaggaatgtgaatcctttatcacacgaagtaaaccaacaacatagtacagttttagagccacaaggcagatatgaggacgcacctggtcactcgtgctaccttgcccagggataaaggattttcacctagagtgcatgtaaacatctctacttgcttacctgagtgcctattcagctgtaaccccagttctttcttatttctcctacatttaaaatcacttaacaggctgggcacagtggttcacacctgtaatcccagcactttgggaggctgaggtggacatatcacttgagatcaggaatttgagaccagctggccaacatggtgaaaccccgtctctactaaaaaatacaaaaattagccaggcatggtggtgggtgcctgtaatcccagctacttgggatgctgaggcacaagaatcacttgaacctgggaggcagaggttgcaataaggcaagatcgtgccactgcactccagcctgggtgacagagtgaaactctgtctcaaaagataagaataaataaaataaaatcagttaataatatgataccggaataaagaccacacgtaatctgctcaaatctaaagggacatgcaatggaagcttaaatacaccatgttgtagttgaaaattgttttaggaaggggctggacagtgagaacgcttattgccctacagagagtgacatgtcaggatttatagtcggaaaatatatacaaatagtctccagagttttaaatcatctgctcattacagaacctcatttcaacataacagttctctggtgtatgaaatggatggaagcaaaagttatggtagatttacaaaccaaaattcaactatgtctcattttatgtatgtgagaggatggcatgcatccatagtcccagctacttgggaggatgagacgggaagatcatttgaacttaggaattccagttcagcctggccaacatagtgagacctcatctctgaaaacaccaaaagtttttttttttttttaattaaaaaaaaatgtgagaggacagaatggtatattaagagagtatgagtttcagaatctgacccctgattctggcctgcttggcacccaatccttgggcaggtttccagctctctgagctgttttcttcctctgaaaataaagccgtctctctagccagggttgttagaaagatcagtacttacatgtcaggccactagcacacagcctagtaaattaacaatggcagctgctatgggacatgacatttcatgtctgaaacatatccagggttttgtcaaagagcaagtgttcagctatagtctttattggtgaagttttagcacatttattgggcaaactctagtttcatgagatacttatataaagttttagttattgacacttttttctatttcatagccacattggtatattttttgcttataatttggctacaggaggggattgaatatagaattcacaagtctaaacttgtgtgtaaagttggctcagtttcgtctaccaaattagagtgatcctgccctccaagtgtattgtaaagtgtaatagaaataaatgggagagaaggctcttcctcacaatagtagaaagaattatggagttagaaaatcaataggctgggtgcgatggcttatacctgtaatcccatcacattgggaggccaaggcagaaagatcacttgagctcaggagttcaggaccagcctgggcaacatagtgagaccctgtctctatttaaaataaaggaaattaaaataatagaaagagaaaatagatgcttacatcagtaaatacaagtgtttttttgtttgttttgttttgttttttgagatggagtttcactctcgtcacccaggctggagtgcaatggcacaatctcagctcaccgcaacctctgcctcctggattcaagtgaatctcctgcctcagcctcccaagtagctgggattacaggtgcccactaccacacctggctaatttttgtatttttagtagagacggggtttcaccacgttggccaggctggtctcgaactcccaaccttaggtgatccgcccaccttggcctcccaaattgctgggattacaggcgtgagccactgtgcctggccaaaattgttattttttaacaactttctgagtgcttggaattatgaaggcagcatttgaaatttttgaaagtatttccctacactttaacctaatcttaagccactaatactgtttaagatttaaaattatcttggcagtcgaagaagtaaaatccagaaaagataaatgacttgctcaagatggttcctgccaaatctagaaccttcatcccatggcctcctgggattgggttttttcatagactatcggcttaagtgctttttggaaataaaagaaaatgtaaatatataaaagataagaaagcaaaattgtatcttctctggggtagtttagcagtagttctgtcttaaagagaattagaccagagagataccatttctaatttgaaactctttggttctgtgaaattggttaaagaggctaaatttgatacaagatctgtctctatgtgatgagccctttgaatattactcagtacatcacggtgaggggtgggtggcctcgtgtctttaggactcttccagtggcatgtgagcaatagcatctgttaccatttctacatgaaatgattggccaatcccacaggttgggctgtctcactcactgagaagcagcagggcagagtggttagggaaaggtgatggagttggataccagcatttgtgtgtctgctctggccacttgccagctgagtgactctggaccaggataatagtgaagatgacaacaataataaaacctgcctcatagggctgttgtgaagattaaatgagttaatatttgcaaagaattgagaatagcacctggcatatagaacatgctatacaaacatttttaaactgtggcaaaaatcggccgttttaaccttttttttttttttttgagatggagtttcgctcttgttgcccaggctggagtgcaatggtgtggtctcggctccctgcaaacttcgcctcctgggttcaactgattcttctgcctcagcctgccgaatagctgggattacaggtgccagccaccatgcctggctactttttgtacttttagtagagatggggtttcaccatgttggccaggctggtctcgaactcctgacttcaggtgatctgctgcctcagcctctcaaagtgctgggattacagatgtgagccgccatgcctggcccatttcaaccatttttaagtgtacgtctctgtggcattaagtaccttcacattgtcgtgcagccaacatgaacgccccgttctctcctccccaacaacccccagcaacctctattctactttctgtctctatgaatttgactactcttggtacctcatataggtggactcatacagtgtttctttttgcgactggctaatttcacttagaataatgtcctcaaggtttatccacactgtagcatgtgtcagtatttccttcctttttaagaatgaataatattgccttgtatgtatataccacattttgcttatctgcttgtctgttcgtggactcttgagttgcttcttccttttggctattgtgaatagtgctgctatgaacttaggtacaaatatctgctggagtcccagctttcgcttattttgggtgtatacccagaagtgggattgttggatcatatggtaatattatgtctaagtttttgcagaattgctgtactgctttccacaggagtggcaccagtttatatccctaccagcaatacacgcaggtttcatttttttccacacctgcaccaccactcgttgtttttttaatgcattttttaatatgtaaaattattggaggaatttattaaccagcagtcatatatccagtgttgttaagttgttgccttagtctttttaaagaggaatgagtaaaatattttgacgaaggaagatttgggaaatcttctggttaatcagatgctggttaatcaatgtttaccagcaaagccctccttctgtgtttctagaaccctccttctgtgtttcatctaacctctccttgatctaatactcccacccccatcctttgcactctacttttaaggagaaaggcaagtcataggtagtaagtttataacaagaattcgtttagaaccaaatggctttttggtttatgtactgcagtgtgtaaaaaatgggttggctcagtttcatctaccaaattagaatgatcctaccctccaagtgtattgtaaaacttttatgaacagacttagcatatccagcataaaagtagcccatccgtgaaaaaagatgtggggaaaaaacagatggaatgagaaagttctggttcctctctggcctgtgttttccctctggcctgtgttttccctcttgacgtgcttccttactttgtgagcacaagtttcagtgggtgccaggggcaccagtgcattaagaaggtcatgcctattttgcgaccagtttccagaaggctctgcggatcacagagattggtagtaacatggggcatagcccaattcagcaggaaacagttaagagccgttgtcggccaacctccccaacagcacttgggttttcctgttgagagcagggactgagagacaggactagctggatttcctaggccaactaagaatccctaggcctagctgggaaggtgaccacatccacctttaaacacgaggcttgcaacttagctcacactcgaccagtcaggtagtaaagagagctcactaaaattccaattaggcaaaaacaggaggtaaagaaatagccaatcatctatcgcctgagagcacagggagagggacagtgatcgggatataaacctgggcattcaagccggcaatggcaaccccctttgggtcccctcccattttatgggagctctgttttcattctattaaatcttgtaactgcaaaaacaaacaaacaaacaaaaaacatggggcatagccacgtccgtcgagagctgccagaatcggtgggtctagggtcttgaataagatgcttcttcccaggaatgatgcctcccagctgggttccctaagctgcctgcacatgtttgaccaagtgtgagctaagctggggtgggtgcttggttggttaaacatgaagttgcttatgtggcctgagacctctgggctgttaaaccaggagctgctggtatgcagacctatgcagcccgtggggtacacatagcacatcttctcaaaaatgccaattttactaagtttgggggtgggaaccccttctattttaaatactgaaacacagataaattgtggattaaaatgaaaaatggatgatttttttaaaagggtgagacagacatgatactttatgctaattggactttgagctgtgcccccaaatattccttttcaccccttgttcattccatgtgtttcctctcttctgcatgtagggttttctatgaaaaagcttattgctgcacaatttgggaagcctggggatgtgtggaggtccagagagactcagaaaggctggtttgcatctcctaagggtagcgtggctggtaagagtcagactgctgcatggctgtgctcgccatgtgtcatctgtgatcttggacaaatggttgggctgtctcaagcctctgtttccactctgtaaagtgggaataataccagtgtcataggattgttgtgggttaaatgctgtgcaatgaagaggagctggtgctggctttgtctgtgtctgtggaagggtggataaggagatgaagcctcacctgctgcttctattagtgcctctcctagccctctatccttacttattcatgtagcaaggtctctacatgctggaattcacagccttcttttattgctggatctcttctctctgccctttgtctccccttagataactctaactcctccagacctgatatcaagatgaaaggaaggctggcttgggatctggagtagctgaagatctggagtacctgaagactactccagaggactttacctccaagggcaagaaacccatctggtgtgctgctcaaggctctccataagtggaagcatcaggatagtagtgggtggagcactaggagaggaaatggggaagcaaggattttgaagggcagatgagagccattatctttaatctccatccccattcccatgggtgcagctctaaacatgttgcaagaaaaagcagatccacatggactatgaatactggtcaactggcaaaatgagcttggtttgagtattaaattaatagtaattattataatatcatcagtgacttaacaattgatgcccagtgaactgtacatgattctcttgcaggtatgtgtattattaggtgttccaagtcagccaccttgaaagaacttttatcaatagaatgaacatctgcccagcttcttgattttgagctgtcacctgatcttctcactttcatctcacaaccgtactcctctcatctacccagcttagaaacagctgtaaaatgacctgggggtctcccttcacctattctggagaagctcaaagacttggaagggtggaggggaatggccctcttagctgtgtccataaaacagagactttgaaggctgaggattgggacagaaatgtgccttgatgtgtgtgtacgatttctctattcttgtcttcacttctccagatgtgttttgcacctaacttcctttctctcccgtccttcaaacctgacttcaaactctcttcatctagaaaactggctctgattaatcccattattgaacaacctcttttccctccctcggcttttctattctttctactttaatgagttggtactttttccaaaggagctttataacttttctccagctgttaaatgggtcttctcctgttagattgtaaactgaggtacaaagtccttcttccaccttatcccttttctctacccatgaagtgccctgcaactatttaaacattagttagagactttgccatgtatcagaagaaacacattctgttgttgtatttattggttttaattataaagcagttggaatgcattttaggattctgaatctccataattctctgccagcactttgcacctagtggaccattagtaggaataattttccatccctgcctagcttcataattgtagacacttctgctgcacaaatgctggcagggctctcatgacttaattctgaaattgtatttagtggctaatacacagagaagatttggctatctcctctggtctgcagctgacatgtggcatgagggaatttacatacagtaccacgatccagttcccagccaagaattaaacgcctggaggagatcagttatttaaatctgaagcagtacagcatgaattatatttaaggtagttgctgttctggctcttgtataaagttctttcagctctgggctaaagaatcataatacctgaaaaccttcatgtctgttgtatgtttataagaacatccttttctaaacttgggaccatttactttctgagagcagtggtactgcatgttagaacaaaaagcacacaacaagccaaaaccaaaatgtttgcagctttgttgccctagtggggtaaattctttcccatgagagagctgttctctgtgtattttatacactttccaagtagtttacacaatcacgggttgtatacattatcttcagcctgcaaactcgatgtgaacctcacccactcttgccaacccaactcccttcccacatcagccattccgtttcctcctactgcttcctgtgctgttgacctaaaagaataaaaatgtttgcactaatataatagggtacctccaaaacataaaggtcagtgaagactaaacaaaaaccaagaatagttttaaatacacaccaactctatagagcaatctattagctctaggaccttgagtaaagcacttaacccatttgaatcttagttaagtggaggtaataataggaggtaataatatttgtcccatctatctgatgagagctgttttagtcatatgagagaatttatgtggtagcactttataaatatgtactacttctatgaaactgaagagctcagcatgtttggttcaagtcttgctgcttgctgttggcaccatatgcagtgttttatgacttctcatgagtctggtctccttacaaaccctaaatgtgtggacctgagctgattttcatatcctacttaaaccagagaaacttcttgctaatgagaactagcctaggtggctttagtcctgaatctaatcacattgaaatatattcttgatccatgactgtattgtcaacatatccccatttgcatagtatgatccacttgagagctgagtttttggcaatcttttttaaattgccctgaatcatgtgttaattcacactcactaacagcatatgcttgcattaatagcacccatctgttcaacatcatagtcttctaattgtgtctgttatattaaacttctcttccaaatataagttttgacttaaagtcagctccttagtatatccctggaacagtgaaatgcctttatgttttgtccccttaattgaacaagcttgtctttatgtaaattggcatattggggtgactttctggtgccaagccatggcttgtttccacctccaccatctgaagtcacgaagtgtgctggctgttacttgttgacttcctttttcttcccccataccgtgctcctcttcctcttgttccttctattgccagtcctgcctatgaaaagcatcaccatgtttttctttcttcttctaatttggatttcatgtcacacaggcttgctgcagccttctcgtcactgtccaggttaggttcccttccattcattctctttcactcacctcttaccctacctgttttctcccattagcctgtcacacccacgctatctctttaggccgttgggccttctaataagatatcatggcattagtcatcttctgatcacttcctctctgctgcctttgaacttctgtgatttttaaaaatacggtaaaactgactaaatattcattgtacattttgaatgaccatgatccttttctagaagttcagatagatcagttagatgcatgaaagtcatcctttgcagtggacctggtattaatgcttattcctcattattattatttttttttctgcaactgaacattaaaacaaatttaggctggacacagtggctcacgcctgtaatctgagcactttgggaggccaaggcaggcagatcacttgcggccaggagttcaaaaccagcctggccaacacaacgaaaccccgtctctactaaaaatacaaaataattaaatgaacgtggtgatgtgtgcctgtaatcccagctacttgggaggctgaggcatgagaatggcttgaactcaggaggtggaggttgcagtgagctgagatcacaccactgcattccagcctgggcaacagaatgagactgtcttaaaaaaagaaaaaaatttaatctcttgttatttctgatatagatatagtaaagtaatacaggtaaatggtatagaatatttggaaaatgtataagaattaaaaaaaaaaaaagaacaaatctgacctcaggtgatctacccgagtgctgggattataggcgtgagccaccacgcccagcccttgtttttttcttttctttttttttttttgtttgtttttattatactttaagttctagggtacatgtgcacaacgtgcaggtttgttacatatgtatacatgtgccatgttggtgtgctgcaccattaactcatcatttacattaggtatatcccctaatgctatccctctaccctccccccaggaagggggacagcccttgttttttcttttgatcttattacaaccctggcattcctcatgtgatctaatttgtcaatattgaatattaatttttttctgttgctggactatatttgagatttttggatctctgagaaaaaagcctataattttactttttatactttcaagatagtaacattaattttatgtggttttcagggaaaaacaaattcacacaaatctatctgctgattaacaagatatctataataatagcgacactctcagaaaagcaacaccctcagaaaagcctaatggctgctgatgtcatcaagcatttacatgcagggagatagtggcacttcagtttagtagaaagatcatgaactttggaaccagttgttttgaatcccaattctgccatttacctgtttttatgatcttagaattaccaaagactaaattagctaacctctctgagtttgtttcctattcgaaaaatgtattttccaatcaattcctatctttttttttttttttttttttttgagatggagtctcgctctgtagcccaggctggagtgcagtggcgcaatcttggctcactgcaacctccgcctcccaggtcccagttaagcaattctcctgcctcagcctcctgagtagctgggattacaggcttgcgccaccatgcctagctagtttttatatttttagtagaaacggtgtttcaccatgttggtcaggctggtcttgaactcctgacctcatgatccacccgcctcggccttccaaagtgctgggattaaaggtatgagccaccgcacccagccttcaattcctatcttaaagaggaatgcagggactaagaagtaatatatgcaaaatatgtgatgtagtaagtgcatgttaagtattaatcctttctgtctgtgtttttttattaacacatcataaagagcttacattgattagaggaataagttatgtgctgtataatatacagaaaaaaaacccacttgtaaccaagagattgttttattttcttgcatgtaccattgaatcatgtgtgatctattttttcatttttcctaatagtcaagggaaaattaagccaaggctcactgttcccttgtcttctaaagcctccaactttgtaggaatatcctctgctattttactatttggggtggtttttgtgaggatagggacagggtgttagcagtgacttgctactccttgggaacagcccagaggactgttgttataagacctgctaattctgcttaacagttgtaaaatattattatttctatggggcattaaagtttatgtaaatatctgggtctttaaactattcattatctatagagaatagggagaattactttaggattggttctaaataacttgagacattttgccctgaccaacagttaaagcataaaaggttcataccgagtcatagggagttgagtttctttcccttcttctaaatatagtagaagcttatccaaactaaagatttttaaattaccttctgttgttggagttaaattttttaaattggccttggaaacttgacacttcattctttcttactgagatctgtatggggatgggaggacagagtgtataggagcaggcagtgggcaaatggaattttctctgtgcctacttggtaataagtaagaggtttggtttccaaactgtgtcttgaaattgtaattgtccaagaaatcccaaatctaggaatcattgcctataattcttccaaattaagcagggttctagatacaccccacccacaaacccagtctgcaggccagccctctgtatatgggccttaatgtctccatgggctgctttgggtttctagataatgaaaaaagaaattagatatatatatattttttaattattattatactttaagttttagggtacatgtgcacaatgtgcaggtttgttacatatgtatacatgtgccacgttggtgtgctgcacccattaactcgtcctttagcattaggtatatctcctaatgctatccctctcccctccccccaccccacaacagtccccaaagtgtgatgttccacttcctgtgtccatgtgttctcattgttcatttcccacctatgagtgagaacatgcggtgtttggtttttttgtccttgcaatagtttgctgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatagtatttctagttctagatccctgaggaatcaccacactaacttccacaatggttgaactagtttacagtcccaccaacagtgtaaaagtgttcctatttctccacatcctcttcagcacctgttgtttcctgactttttaatgattgccattctaactggtgtgagatggtatctcattttggttttgatttgcaagaaattagatattcttattcagatttacacagcggaccaaatgaatttttctcttgtgtgaaatttataaataattcttctattctggaaagacatcctgggtttggagacccaggcttggtttaaaaacaaatgaacagtctgatgcagtggctcacacctgtaatcccagcactttgggaggctgaggtgggcatccctcaggaggtcaggagtttgagacctgcctggccaacttggtgaaaccctgtctctactaaaaatacaaaaaaaatttagcctggcatggtggcgcatgcctgtagtcccagctacttgagaggctgagtcatgagaatcgcttgaacccaggaggcagaggttgcagtgagccaagatcgtactactgcactccagcctgggcaacaagagcgagactctgtctcaaaaaaaaaaaaaaaaaaaaaagagaacaaacaaaaccaacaagtgttaagtagatgtttgtaagtatgaaaatagtgtggggacttttgtatgaaagtgggattaaggaaccctctttcatgtgtagatcctgatgccatgtacattgaaagcatatttgcagaaaaggataaattattttcgtaaagcctaaactatctctccattttcctgcataattatgacaagcttcttaactattccaggccctagtgacctcactgcaacaaagagggtattggcagccaatcaggaactctaactcttgttggtaaacttgtcttgtcactgttagttaccctcacttctccacctgggaaattcttctaatgccaaacttgaagatttggggctttgtgttattatggtaggtggccatagtcgcttacagccttgtctaacccgaatatcctctgaagttgtgtgttgatttataactttggaaggttcttagaaatgtgtcatgggggaacagttccaggaatgatgtggaaggcaggctttccataaagttcccctgcccttagtatcttgtgtgactattatgagagcagcaaacttcgtaggactaaacttggaaggacacagcatctctgccttgaagcacaaagttgagcacaccattcagcagcctttactaagcacctattatttcttttgcccttggtagggatatagaaatggatgagactcgagggcctgtgctcagtgtctcataattttagtgtcttgatgaagccatgtttttaacatgggggtggcagtctctttcatcgtttcagattctttagagtgcctgtgaatacgtattggtttactaacaacttcggcctagggtttgcctatttttcaaaagaaaattcagtttaaggaagtttgattatgtagtcctttaaagcttaagattaagcagttgtgaaatacttttggaagctggtatgaagcaggaatgtaccacgggtcaaatttacagagggtatcagcttacctgaaatcttggactttaggttctctcatctttatattccattctcccattcccaccccagttttagtgtcttggaatcagttctcttccttctagtgtgttctttgatgtataaatgccatctctgataactattctttaagttgtgagagggggcagatatccttttaggtattttcttccagataaaagcagttcccaactcttagaagatggttcaatgaacaattgaaatgaattatctattcaagtatacttaggattccttgtagaaattttgaaacacatagaataacaatgtgtatttataatgctaaggctgggcaccatggctcactcctgtaatcccagcactttgggaggcgtaaactggaggactgtttgagctcaggggtaagttcaaggccagcgtgggtaacatagtgagaccttttctctactgaaaataaataaaggttaaatttttaaaaatacaaaataaatgctaaattgtggacatatttttttctttctttctttcttttttgagacagggtcttgctttgtcacccaggctggaatacagtggcgcgatcatagtttgctgcagcctccacttcatgggctcaagtaatcctgcctcagccttccgagtagctgagactataggcttgcaccaccacactcagccaattttttgtatttttttgtagagatggggcttcaccatgttgcccatgctagtctcaaactcctgaactcaagggattcattcaccttggcctcccaaagtggtgggagctaccccagccggacatatttctatgaattggtaattcctggttttctgcttttccttgaagagaaacaccctaaataataccctattacagaacagattccaagccctggttttggggcctcttgccaaccctcccttcaatatatccctcaaatctaagcatttcgtaattatgccaaactttcaattgtttaataaaaactttgagagaccttttgagtcatattcatcactttgtgttccatctccataataaactggcaccaagcagccactcaaatgtttgttgaacaaatgagtgaattttaatacaaagtgtatggtggccttggtgtctctgtgtgaaggtagcaggtagagaataggggaaattaaacagcgaccatgtcaactccttattgaattaggtagattttgggctatttttacattggattttgtacgtgttctttgggaaatggactcctaaaggaccctttcatttctaatttatacttctatttcaaaatactctctaacaacttgctttcattctgctccttgaatctgtgaataagccttattgtgtaattttcatagaatgcaattgctttgaactgtcatctgatgctgcaagtggtattttgtgagttgctaatacatcagaaagctgtgttcttcacaatgtcctcatgttttttgtggttcacggcagcaagtaaagatgaactgtggaggttgcagttaatcaagttactttaaaatgaaaagaattttgaagccacttaaatgacctgcttcttgggcttggcagtgacaagtcccttcctgggcccacttagatttaacagcaggaggtactgggcaaagaataagggctgcaatgttgacagaccttagttccggccctggctttaccattgacccagcaaatagctgtgggcagtccctttcccttgcttgactttggtttcctcatttataggaaagagataatgcctatctctgagggtgatcatgagaaccacagaaccacacagtaacatatggaaacgtcctttataggcagtaaagccacatcttaagtgaattattttattagctccatgatggatctttaaatgacagtgttattatccatgccagtggttcttatcaaaagccactacttagtaaatattgagtaatgcagaaatatttgcaggcagtctctgtggcccagaaggacttgcttttgctgttaagattttctcaaattccctaaccttcctagacttacaatttgacagtagattatgaaaggtgttctctcccattcaaggaaggtgaggccaaagtgtgtgtagttagaaagtcagtgggccaggcagaaggtcagaaggcaaggaatgggtatgtacaaggaagtcccatgagggtacacattttttatacttattaccctgtgtctggtgctttgactcacatgtggcacatagaacctacgaattgaacattagttgagtaaagtccacagaatggtgctatctttgctccattaatgatcatactcttattgagtgtaaataaataaaattacctcacagagatattttggagccctttgggagcctttcccgataagatattttattttttcatcatatatttttacagagcatgcagcctgtgcagggaggtgtgctgggcaccatgaggacacaaatacgtcttctaggagtttactgttaaccaaagcaggataggagggcattttgagctgagacaatcaggaagactttgggaagaaaagtgcccactgggtcaagcctggaagataggtaggatcccactagatggggtcaatatgttgcaattgcaatttaaagctttgtgggtgtgtattttaattcacacattaagtaaaatctcttatttggacaggatgataacagagtttgggagcccctcagcagctgtcctgggctggtacaatattgcatggtttgtggaggcagttgtgggcagaggccgagggacggggttctgctggggcttctgtcttctgctggggggttagttgaggccggaagggtgcagcagcataggaaagatggggagagcaccgcctttttaatgtgactccagtgcccactcttccaagttggggatggtgtgacaagcacatgggctcccactaggagttttattttggatccaaaccttactgtttctgaagtacttactataaaatgaaaatatcctgtcagaaatgggaaagtctttaagctgaaattaaaaagagaaactggaaatcatgaggtatcttggggattaactgttcagaacagtagagatggaggattaggtgatggtatgtgagtgtggcaggtatcatttaagaaaacacagggaaagaaatataactttttttttgagacagagtctcatactgtcacctaggctggagtgcagtggtgccatctcagctcactgcaacctccgcctcctgggttgaagcgattctcctgcctgagcctcctgagtagctgggattacagctgggattaccaccgcgcctggctaatttttgtatttttagtagagatgggatttcaccatgttgcccaggctagtctggaactcctgactcagtaatctgcctgcctcgacctcccaaagtgctgggattacaggcgtgagccaccgtgcctggcctaaaaattataatttttaaagtctattcattatggagtaatgatgagctcacttagtgaggattcactggaaggtagtttttctgtacgcgcagagtgctatctatgtgcaaggagccctgacaaattggcaggagacatgaagatgatcaaaagcttcctctaaggatcccctagtttggagagacagacagactgatttacagtggggggcttttctgatgagtgatgtaataaaaatgtgaactaaagtgccaaggagagccaatggatttagattcagagatccatggaattttgcctgagatgatgtgaaaggcaccacctgcagaaggtgggagaatggctttccaggcagagagaagggtggagcagaagcactcagcgttggagggagtggtgtggtcctggaacacggtgctgcctgggagctctggctaaagtgtgggcttcctggatgtggggagatgcaaagtgctctagaacttgttctgtaggaaataggggagccatcaaaagttttgagaggggaagtaataaggaagacgcttctgttggccatggggagaatgagtggaaaaggggtagtggctgagtgactagacctgttctgagagttttatgggagagacattaagacctggactctcgcaatggaggtgcagaggaagattgagagcttctgtacttttctgaaatgtgagagctcagttttaaagtttagattggactgagtttattaaagaaaaagaaaatgtttttgacacatgtcaatctttgttgacacccgttggtatcaatgctgtggggtgaggtctccatgttcaaggaatggagccacaatggaaaattgggagtggtaggaagggggatgggacaaggatgaggacatccatggaagctcctgcccgtttgcacactgctttttttttttttttttttttttccctgagactgagtctaactctatcgcccagggtggagtacagtggcacaatcttggctcactgcaacctccacctcccaggttcaagtgattctcctgattctcttgcctcagcctcccaagtagctgggactacaggtgccccccaccacacctggctaattttttgtatttttagtagagatggggtttcaccgtgttagccaggatggtctggatctcctgaccttgtgatccgcccacctcagccttccaaagtgctgggattacaggcgtgagccgccgcacctggccttgattcacttgttagaaataatactgtaaaaataaaaaaactagccaagtgtggtggcgtgtgcctgtagtcccagctacttgggaggctgaggtgagaagattgcttgagcccaggaggctgaggttgcagtaagtcatgatggcaccactgcactccagcctgggtgacagtgccagttcctgtctcaaaaaaaaaaaaaataaaaataaaggaaaagaaatgatattgtaaaatccaaaggcaaatttctctctctgcctggtgtttcaatactcctgtctctgaatgttaaatgttcagctgcatatgatttttttctgattgattgtctcaggtgtttaatgaagactgcctttgtaaatcacatgttgttatcctctatttctagctattgtggacgatgaaaggctctctgcagaggagatggatgagaggaggcggcagaacattgcttatgaatatctgtgccacttagaggaagccaaaaggtaagatccagacttagtctatttgtgcaccatctcttggagataagctttgtgataagggcgtgggatttgatgaccagagggttctgaaatgggccagcaattctaaagagttgtcgtagttggagatggccagggagagattcttgcctgcactcagtgatttagatttggccaaacctcccatgccaggaggccagtgggctaggggatgacccctccacactctgctccactcctgagtcacagctgggtgcacatcacactcctgtgcatatgctacatagttctaataactcatttgcagtcttgttggcagcaggataatgggagaagaagcatctatttcttgcaaatggttgggcagagttgagaaaaagttgatgccacagccaaagttgaggcactaggaggaaggcaactattcatttccctgcctcggagcctcccaggaaatcacggggccaactgcagattgtttcaaattcttcatctcactggcttggatgtagaggagcaacaatgacttaaatcaacttcctttttccgcagagcttccttgggtcttttccccactcgcagcccaatgatgataaatgcccagcaggacagtggcatatcagactgaagtccatcagtccctaagtaggtttatgacagcaatctcctctttaaaccgtgggtgtgtggccacttagggtatattgtctctaaaatcacattgactcttttaggctttttagattaaataaatgttgcgttctccaaggagaaagtgaagataaagagtcctaagtgcaaatactttcctcatgagaggaattgagagaactttatcctttgtggggtgaatactacagagttcatataccatgagttagagtttgattgaatgctttatgccagggtggagcgacagtattgttccctggacaaagatatgttccagccctcttagctatatagaaataaatacttggttaaatggtcactggtgttaattatctctgatcactgatgaatggctatctacagaactagaatgatgaggtttttaatcagtattttggtgacacatgccctaatttgacatcaaaattgctttcaaggggtttctcagagttgtttaatattttagtagtgtcacgtaactttctttaggctctaaaaaccaagttttaaagattgtttaacatgtctgtgaagtctacagttaggttgcaggatgctagcgattcactatcagtctaagatcattaaaaacatgcttttagtcaagttgtcgcaaaaaagttagataaggagattgattcataggcattagaaagaagtggtcccaaccactcctgaggctaaggtgggaggatcacttgagcctgggaggtggaggctgcagtgagctgagatcgggctgctgcactccagcctgggtggcagagtgagacgctgtctttaaaaaaaaaaaaaaaaaaaaggaaaagaaagaaagaaaaagaaaagaaaaaatatactttcagtgaataagttcaaggagatagtagaaaaacttacttttctattgatactcactttacattttgtttttgcctcctgtttttaacaagtgggaaggggtgtcatgtagaggaaaatgatatgtgattgggagttggtttgcctaacttcctggtcccagctccaccacttacacaagcagcttgaccttccacagaccattttacctgtgggaagttcaatttgtcccctctgtaaatgagacaatcaagatgatgttacttattgccctacttattcatggattcaaggatttttaaaaaatcatttaaagaaggtgaaagtattctgtaagctatagtgccagtcaggtttatggtgataacataagcaaagttttctcctcagtatattgaaatggtataaatgtagcttgaaagcttgtcatcttctctagtatttttgaaattctgtagttgaattttgtttcagaaagtcagcataatgattatttcagattctttgaggaaaactttccttggaatagtttcatgaaaataattatcaaaatgtacaatttttcctctaagatggcttttcataaatttatttgatgagtatattagatgtagtatatatttatgaatcttttattaagacacaaatactttttttcttttttctttttctttttttttttctgagatggagtctcactctgtcgcccaggctagactgcagtggcgggatctcagctcactgcaacctctgcctcctgggttcaagtgattctcctgcctcagcctcccaagcagctgagattacaggcgctcaccactacacctggctaatttttgtatttttagtagagatggagtttcaccatgttagccaggctggtctcgaactcctgacctcaagtgatccgcccacctcggctcccaaagtgctgggatgacaggcgtgagccactcactgtactcggccaagacacaaatactttgaaagaagctgatttttggtcatggattatataaaaatttgtggctactactagacatatagttgtgctgatttaagaaagcatagtgcacagaaaactcatggtcttgaatgcaagaaatacaggaaagggtgaatttgtctttcttgaaaagatgagaggatttattgcatgattcttttaaagtattagtacctttggaatttgtgatattgggtttattataatgcacatatgtgtgttcacatgaatggagttgacttagaatattgagtttctactaaattgtatgcttgtactgtatatattcatctaggaagtgtttcttgtttctgatttcagttgaaatgactttattgcattttaattaaaaatgtattggttctgtctttgcacctgtttttctttctggaggtgagaattggaaggtatctagtttgtatatcctgtaacttaagatttttacaaattgagaattataatattccagtatatcttttattttggttttattaatttcaaaattctataataaatcaggccattgaaaagttctttattcagaggggacatcactaccaacattacagaaatacaaaggattataaaggaatactatgaacaattacatgccaatgaaaacttagaggaaattgacaaattcctagaatgacaagctactaaaactgactcaataagagacttaaacatctgaaaaaaactaatataaacagaatgagacttataataagtgaagagcctgacttagaaatcagaaaacttcccacaaacccagataacttcacagtagaattctgccaaatgtttaaagaagaattaagagcagtccttgcaaactcttccaaaaaatacgaaaagagaaaacattttccaattcattcttctgaggcctacattaccctaataccaaaaccagatagccatctcaagaaaactaaagaccaatatctcttatgaatacaaatgcaaaaatccttagcaaaatactagcaaatcaaatccagcaacatataaaatatatttaataccatcaagtgagatttatcctaggaagcaagcttggtttaagacctgaaagtcaatatcatagaccatattaatggaagaaaggacagaagccatatgatcatctcaatatatgcaggagaagcatttggtaaaatccagccccctttcttgacttaaaacgttcaacaaactaggaatagaagagaatttcaacctgataaaggacatctatgaaaaacctacaagtaacaccatactcagtggtgaaatacaggaataaggatgttttttcttaccacttctgtttaacattgtactggagattttagccaggcagttaggcaagaaaaataagcaaaaggcatccaggttagaaaggaagacgtgaaactatttctaagggatgttttctggtttatagaaaatccataggaatctactaaaaaacagaacagaagaaaacactaagaaaaccccaccacaatgagtccatcatggttgtaggatactaggggagtgtgtaaaaatggcatttcttgacacgagcaataagcaatctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacagaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggaggctgagatgggagtattgcttgaggccaggagtttgagaccagcctaggtaatgtagcgaaaccctgtctctgcaaaaaaaaaaaattttgaattagctagatgtggtggcatgcaccagtagacctagctactctggaggctgaggcgtgaagatcactcaggaggctgaggatgcagtgagttacgatcacaccactgcactccaggctggatgacagagcaagaccttgtctcaaaaacaagaacaaaaataaagtttatatggagatgcaaggaatgcagaatagtcaaaagtgtcttgaaaaagaaacgcaaagttggaggactcatttttcaatttcaaaacgtacttacaaagcccacagtaattgagacagtatggtactggcataaggatatgcatatagatcaatagagtagatttgagagtctagaaataaaccctaacacttctggtaaactgattttcatcagcagaataaagtcaattcactgggagtgagagaagatgcccttttcaacagaggatgctgactactcagtgtctacatacataaaaatgaatttggacctctgcctcacaccgtatacaaacattttcttaaaatggattattaacctaaatgtgagagccacaactgtaaatctctccagaagaaaacaggagtaaatctttgtagccttgggtgttaggcattggtttctgagctatgacaccaaagcacaaccaataaaagaaaaacagataaattagacattataaaaactgaaaccttttctgattcaagagataccatcaagaaagtgaaaagacaaatcatgtgtctgataaaggttacatgtattcagaatatacaaagggttcttaagtcgggtgaggtggctcacacctgtaatcccagcactttgggaggctaaggccagcagatcgcttgagcccaggagatcgagaccagcctgggcaacatggtgaaaccccatcgctacaaaaaaatagaaaaattagctggatgtggtggcacatgcctgtagtcccagctactctggaggctaaagtgggagaattgcttgagcctgggaggtggaggttgcagtgagctgagatcacactgcactctactctaacctgggtgacagagcaagactctgtctcaaaaaaataaaaataaaagtaaagcacttttaaattctacataaagagttaatagcctaattttaaaatgggcaaaagttctgaatagacatgtctccaaagaagatacacaagtgatcaataagcatatgacaaggtagtcaacatcattagtcatcagggaaatacaaatcaaaaccacaatgagatgttacttcatacccaccagcgtagctataatcaaagatggacaataacaaatgttagtgaggatgtagagaaatcaaaactcatacattgctgaacagattgtaaaatggtgcagctactttagaaaatagtctggcagctctttaaaaaattaaacagagttaccatatgacccagcaattatcctcccaggtatatacgaatgaaaattgaaaatctatgcccatacaaaaacttgtactcgaatgttcacagaatcattattcataatgacaaaaagcagaaacaatccaaatgtctacccactgataaacggtgatgtatccatacaatgaaatatttctcagctataaaaaagaatgaagtactgatacatactacaacatggatgaaccttaaaaacatgttgagtgaaagaagctagacacaaaaggccacatattatatgaaatgtccagaatagacaaatccacagagacaaagtagattagtgattgccagggcctaggggaagaagagaaatgctgggtaactgctactgggtatgggatttctttttgggctgataaaaatattctaaaattgattgtggtgatggttgcacaactttgagtatactaagaaccactgagttgtttactttaaaagggagaattgtatggtatataagttgtatctcaataaagctatttattaaagataatttccttacactggcttggagaggtccttaggaagctgttaaataagatcaattggtattagcagatacattgcatatagaaggtacccctaagatacacgagatatctaaatactgtgtttgttttacagatatttattgagcatcctttatgtgtaaacaagcctaggagggttgttttgggagatggagttcaggcaacaaataatgctgtgctcagaaaaactcgccatttggttgaactttttactcaagagtttaaagttattttccttcatttatgtttgctctgttaatctctctgtatatgtgtatcatctccatatccagccatcatcctcctaaacagctctcatatgttcacctctctatcccaccactgctagcccgccaaaggattccagcatctcttgtgagactactgtagtggtccttaactggtttcttcatgagtctctagcctccttcaatcctttatctgtcttatagtcagataaatcttttcaaaactctgagcaaactcctttacttggcctcataggctctgcatagtccagttcaacctctttagttttacattgtgccgcactgctctgtgcttcaaccacattgatctgttttattccctgttccctcctgcacaggaccttgccatgtgctattcgcttttcatattcctctttatctagtcagacttacttcctcttcagattgcagctcactttttcagggtatccttctctggcttccacatccaggtcaaactcaccgattagaaggccttttgacatcacatctattgcatgtttgaatgaataacgtaatgcccagtgttggatcagtatcattcgctactaaggaggtttgattatgctctgttttctgtacattttggatgttggaggtaacaaggaggatatgaatcagactcacggtagacagctagactgccagcctagcggtaatctttgtttcactggaaaattctatattgcagttagatgatgcaagtccttcccgacaggtttgtgacccagtaagttatgaagctgggaattccagacaacttaataagccgtgataccacagtgaactagaaaatatccagaaaggcgtatagagtattgctcaatgaatgaatgaagagagaaagaggaagcctgtgtattaggaggacttaaggctgaaattattgctcaaactttataaaattatgaagtctttacgtatagatgttaagactcaaaaaatgaattttttttttttttgagacgtagtgtcactctgttgcccaagctggaatgcagtgcagtggtgcgatctcggctcaccgtaacctccacctcctgggttcaaacgattatttctcctgcctcagcctcccaagtagctaggattacagaagtatgccaccatgtctggctaatttttatattgttgtagagacaggatctcaccatgttggccaggctggtctcaaactcttggcctcaagtgatccgcctgcattggcctccaaaagtgctgggattacaggcatgagccaccgctcctggcctcaaaaaactaatattgatggcaatgaacaaaatattaaacaggcttttttttttagggccaaaaagaagtaatttggctcttcacccaaattacttcaccctacaggctgaaggattcagatgaagtggagagtgaatcacttctgttaagaggcaaaggatgtcttgtatatgtattagttgcctatgactatataacaagttattctaaaacttagtagcttaaaacaataaacatttatctcggaatttttgagggtcagaaatctgtcattgcttaactgggtcctctggttttgggtctctcacaaagctgcagtcatctcacagttcacgtggggcacacccacttccaagccacccagtgacactggcaggattcagtttctgacaggtttttggactggagatctcagttccttgctgctgttggccagagtcttccctcagttgctcaccacttgggcctcttacacatggaaacttacacatggcaactggtttccatcagagtaggcaactgagagaagaagatggaagctagtctttttgtaacctattcttagcaatgacacccatcatttatgctgtatcctattcattagaatcgagttactaagtcaaggccatgctcaaggggaggagttttccacaaggggttgaattcagagggatggggatgactggggcaccaccttagaagctgcctttcacagggtgtcttcataggcttttgaaatggaccccagaaagggaatttgaggataaaattatttttgttactattagaaactcaatcagaaattgaatccttcctgatctgaatgcttacggttctaagcttactgctgccttgattgttttttgttggtttgtgtttttgtttttaattttaagggtcttgctgtgttgcccaggctggattcaaactcctgggctcaaacaatcctccagcttcagcctcccaagtagctgaggctacagttgcttgctaccatgcctggcaactcccttgattttttttaattgggagctgttttaaactaagccttttcatttctttgtcatttaaaataatactaaatggactttttaggtttccttttcaagtaggccctcaaagctaactttatagcttctttgctgtggggcttttgctgaaatgaaactgtacagacaagtctactactaatatgggctttgaaatgtcctctctgatgccagaaatcctactatttaaattaaaggagtaacttttccaaaagaattagtactgctgagtagattttatattaatctgcctaaaatttattcaaataatgaaaatgaatctgttttaagaaattcagtcttttagtttttaggacaactatgcaaaaatgtacgatggagaattctttttggataaactctaggttgaggaacttaatccaaccggagctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaatgcacagaaaacttttgctgtgcttcctttttctgtcctacctctgaaaataaactaagcaaaaaaaaaaaaaaaaaaaaaacacccttcccttggtgataggcttgtttagaaatattatcttcaaaggtctctttaggtaagccaagccattggctatattggtgagtctgggacagttatatatgtgccctggaaagaaaacaaaacacgggtgtgattccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaaaaaaaaaagagaatcttctgactggggaatactttagagaatccagtggatttcctctgcatgcttggacctcactatccttattcctaggacatacccatggataagcaatgctaataagaacttggaatttccagggaaatatttttctttgttgctctacacacaaaatagtaatgaaatttttaagaattcctaattgcattttcaaaacataaatagttttcatgtttccactgtaactctccatttctcccttccctcccttgttctctccctggctctgacctcacctctgctttccacggggagcaagatgaactgcttggttgttccatgcggcagctggtggggcagagggtgcagtgagctgagagcagggaccccctcgcaagtctggcacctggttgaggggaaggcctgcttggggctgctttccaaccagcttgcctcaggagccctgtgccagcgaggctgagatcagggcctggcacatcccaatggcagggagagagtaacttgtgaggagcccagacttgtccagggtagcttggcagagttggagaggtggtcttaacagggtgatctccgtggcacaggaatagacgtgatcccagccagccctacctgccaacaagtagtgcttgtagttggggcctcagagaggtgttggtgctgagggccagctggcggtgaccagggattatgctgtggagctagaatggaaggaacacttattaaggatataaaggaaaaagctacaggacttggcgggggtctggatttgggcagcagaggaggacactgggaggtcagatgccctggggcagatcaaagcattgcttatctgactcagcaggacacatttcgtgttctctgtctgccaagcctaggcttgggcatatagtaggtggaaaaagttctttgtttttagtttcacatattgtactagctttggatgtatgttggacaggtgccaatcgggtatgttctgacagatgaaagtataacttttcagagtgctggtattttaaaatacaaataatcggtattaatcatctccagccaaagacaagttgagcaactgatatttgatcccaaagtttatatttgtttctcaggatcttcaaagttggaaacctgggagaggtttggaattttccatggttgcaaatgtactttactcacaaggattatcacacaagtgtctactcaccaggcacggtgctttaagcattcaacccacatggtctcgattctcacaaccactctgtgggaaggagcattatccccatttgatagatggaaaaaccaagtcttggaaaaacttaagtaatttattcagtgtcgcagccaacaggcgacagcaacagtattacaacctaggtctttctgacttcaaagactgtgcttaaaaactataacatactgtcccatttctttatttcttaatgtgttttgatcatgtcttccttgtaagtccaaaacatggtcttggtttttaggttctatatgggctagttctagttctagctcttgatcaataaattctcacttaagctttggtggaattagcacaatatagctatccattggctatatatggctatatattgttttattttcctttctctttttttttcctgtgaactgtttctattttgttttaactggtactattataagtagtttgttctgggaataatttatcttgtatttactttgtgttcttcctccctctttctccttctctcttttgctcattttaggctagctctttcttgctctctcttttttcaattaaaataaaatagagatgagatctcactatgttgcttaggctggtcttgaactcctggcctcaggcagtcctcccaccttggcctcccaaagtgctggaattacaggcatcagctactgtgccttaaagtattattaagaatttgtacttctctatgatgtagactttattctgttctcttcacccaagaaaattttggtgcatctttattcttggttaggcctccataccaccttcaattcatcaattatctttttggttttgccactattatgactggtttcaaagaatgcttggctttttgttgaaacatcaaaaggtatgagtagcaaacagcactgagatctcttccttcctgtgtgaacctccccaccggaagctgcctcatgctgtgatgcttaaaagtcataaaacggtatcattattcaaggcatagagtgactttagggaagctggtgggggagaacatttgtacaaggttgtcacagaatgatttctttgtgtcttccatttttagggtgatatagaatgtagagcgatcttccattgccttctcagtctgaacacctttgtttttctttaacagagtcaaatccccatttcatatatggggatactgaggctcagaaatttatctcacttatccatggtggagttagtggtagatttgggattaggataaaggtcttctgactgtttgacagtgctctttagttccatgagtctctatacaccatgttgagtagtaaaagtagaaagctcaaatgagtctctataaatcatgttgagtagtaaaagtagaaagctcaataaagaaaaaatataaacatgaatattaaacttatttggtagattcagttcaagtttgcttttggttaaatgctgcaaatggtttgggggaattagccattcatatgttcttgtccttgatctttcatttttgctgagaaacttgaacccattttggtgcaagaacaggaattcaggaattaacatttctagtcatttctgcactctgtactccgtcctacttggcttaatgtccctgggttgcttttttgtttgtttgttttttcccatcgtgtgatttgtaatacacagcttttcctgcccctggtatttctcaaggcaagagttgaggcagctatgtcatctgggagagtgacttagggcagtgatccccaaattcatttacacctgcatcaaggtcacttggatgcttgtgtgagtgcaggcttctgaggatcactcctgaccctataaggccatctctaaggacaacctccgcctcccaggttcaagcgattctcctgcctcagcctcccaagtagctggaatcacaggcatgcatcaccacacctggctgattttgtatttttagtagagacggggtttcaccatattggtcaggctggtcttgaactcccgacctcatgtgatccacccacctcagcctcccaaagtgctgggattacaggcataagccaccgcgtccggctgaggtctgccttttaacagagcactggagtacactattatgcacactgacatttgagatagcatctatggctgaggctgtctcagctctcagccttcccaccccagcttagaaaaaaggaacagaggataccccttcctctgggatgagaggggagagaggaaggatactaagagtcaccatctgctgaggtgaggagggtggaggcatgaaaaagcagtagtgcatcagccagggttggatagaaagcctgagtagttttgaagatccaattagtgttataaatgttctttgcagagccaataagcattttcatgtgaatttctccaacaagataaaagaatggggtaactatgcctagggattgacctgctggctctgaccaagtcataggtgttggggctcagacactgatgccccaaaatacagcattttgacattccaaactgaagaagcttcaaggtgtctctgacattcctgcatcccacattctctttcaaaggctttatctaccaaagatcgagacccaccaggggaaagaattgtttttccttcccctccctgtaagaccgggaatgtggccacacctgaacagaacctttcacaggatgacatacaggttaatctctgttccccatcccttttccttggtaatctcaaccaaattccttttctgcccccctcccataacctgttttgctgggatggtagttaagcttctgagtcacttgaggggtgggtaaacatgtgagtctacttgcgtacatgttaataaaacttatatgccttttctccaattgatcggccttttgtgagttgattttttcagagaaccttcagatggcaaaggggaggatttcctttggcctctgcatgggaaacagggactccagggtgttcatgagagtattgctgaaattgggttcttgaggtcccatctggccgaggagcctatgaagccaggatgggaaagatggagtggggtgaaatcaaggaaccacctacaatgagaataaagggcaggatctataagaataaggaagtggagaagtgagtaaatagaaaggctatagtccaagatttggaagccttgatcttacaggtggagtatttccaggtagtgataacgtgcaaggtgtggtgcctgtgtgtggttggagtgtagtggaggagtgttaccaaggtcatccaccttcttgaagccacccagcagaggcaggcctgggaggaaggcagcaattgtggcaagaaaggaaaagtcctggaggtcaagaaatgagtggcaaggttaggggtgagagggaagagtgaagccctgagaagtgaggtgatggacaggatgtggcctgggagaaacgtttatttgggaaagtgatgactatcctctctttgtcctgggagtcaaggaaatttggcaaacaaccacccctggagtgggtttatgaggggtgggattttgaagcaaaagccagcttttcattagacaagtaggtagagaaagtgtaaacaaaaagtgataatataggagaattacaacgggtcaggagttcagaggctcattggaaggagtgagtaggcttggggtatgtttaaggagggctggttagcaggatggagacagatgactttatatgagttctgggggggtcaggacttttactagagtttactaggaaaccaaatccactgcagaaacaggcatagatttatgtaactgtggtaggggcccattagagatcttgtgttactgatttactaattgtgctactgatttattactaattcattagctgtgacatacactttcagcaagtgactaaaaccttatgacccagagtaaaataattttatatcatgacccaggtagctgtgtgatatgtgtaataagtgggcgtgtgtgtctaactaaagattcaccgagcaacacttaacttctactatatgcaacagcctcttatgtttactattctgttctgttctaattcattttctaagaaaatgctggtcatgaaccactgtgttgattttatgatccgttaaaacattacaggtcaggcatggtggctataatcccaggactttgggaggccaagatgggtagattgcctcagcccaggagtttgagaccagcctgggcaacatggtgaaaccctgtctctgcacaaaatacaaaaaaaaaaattaaccaggcatggtggtgcacgcctgtagtttcagctacttgggaggctgaggtaggaggatcacctgagcctgggaggtagaggctgcagtgcacagtgatcacaccactgcactccatcctgtgtgaaagagtgataccctgtctcaaatcaaaacaaaataaaacattacagccgcatttgaataaagtgctttacactatcttgagcatgttttggtaatagttatgttctgcataacaatatcccataagattataatggggctgaaaaattcccaatcaaagcattactcacgtgtttgtggtgatgctggtataaacctactgtgctgccagtcatatgaaagtatagcgcatacaaatgtgtacagtacataatacttcataatggtaatacttatgttactgctttatgtatttactatgtttttatgttatttttagagtgaactttctctacttaaaataaaaagcaaattgtaaaatggccccaggcaggcccttttggaggcactggaggagaaggcattgttatcataggagataacagctccatgcagacctttcagtgggacaagatgtggaggtggaagacagtgatattgatgatcctgactcatgtgggatcttgctaatatgtgtgtttgtgtcttagtttatagcaaaaaagtttaaaaagtaaaaaaaaaaattaaaaagttaaaaatagaaaaaagcttatagaataaggacataaagggaaaaatatttttgtacagcagtaaaatgtatttgtgttaagctaatgagtcaaaaagttaaaattcaaaagtttataaagtaaaaaagttacagtaagctagggttaatttattattgaagaaagaacctttctttttctttttttgagatggagtttcgctcttgtcacccaggctggagtgcaatggtgtggtggctcacgcctgtaatcccagcactttgggaggccaaggcgggtggatcacctgaggccaagagtttgagaccagcctggccaacatggcaaaacccctatctctactaaaaatacaaaaattagccaggcgtggtggtgcatacctataatcccagctacttgggaggctgaggaaggagaatcacttgaacccaggaggtggaggttgcagtgagccgagatcgtgccactgcacttcagcctaggagacagtgagactccgcctcaagaaaaaaaataatttagcataccctaagtgtacgatgtttataaagtctacagtagtgtacggtaatgtcctagggcttcacattcactatcctaaaggacagtgacacaagtcctgtcctcaagtgatccgcccaccttggcctcccaaagtgttgggattacaggcgtgagccaggcgtggttgtgcgcacatgtaatcccagctacaggccgggccccctttttatgtttagatacacaaataccaccatgctacaactgcctacagtactgagtatagtcacatgctgtatgggtgtgtagcccaggagcaataggccatatatcctaggtgtgtagaaggctgtaccatctaggtttgtttaagtgcactctgtgatgtttgcgcaatgacggaatcacctaatgacatacttctcagaacacatttccctcattaagtgatacatgaccgcactaggtgctgcttcctaggcatctctgggaggaagaacattaattttaattttctgtacctagttcatacttggggtttattgtaccatctgggagaaaccaggaggtgtttagttaggcctttccctgctcacaactttcataggctccgttttccctgcaggatcatggaagggcacctcctgagcctggcccaggagcccatactcaccccttttacaccgcctccgccttcccgccatggttgatcgttctctcctcagttatgcctcaggtccctgtcctgcttccactgtgcatagtatgctttatggtagctttctccatgtgttgtcctctcttagcagtcagggagctccctgaggaagacattctcactcgctgtaccccactgccttgcacggggcctgtgcagaatgggtgctaggttgctttgcctgagtgagtgttgtgatctcagaagttctggcttaggcttcttgtccctgtgcttttgtctagagaggctttgtgagggacgctgattctgttggatagcctttgaatgattttcattctcaattgcatggatcgctttggggaacacagaccagctggctgtgcttggcagcaaggtgttgtgtggtggaaatggctgaattccacatatcctctgttactcacagacatttaggggagcacgtgccatccctctcacaattttgaatacataggaccgggtgctcctcacccttccatttcagtgggatagtttgtctagcagctgctctgtgctgatgacattatgaaatagggattttaaaggacctctgtgcaaatggagcccctcaacccctgacgatgtgttctgcacaaatagatttaagtaggctttttatgcatcagaactgcctgcaatctgaaacacaccaacaagacaggttcaaggatgaattaacaaaggttcagcagacttaaatgatattcagaagtcttgtggctaagtcaaattataaataaactcatgtgtgtggtgtagaactgtgtgtgtgtgttggttttgagagactgatagaaggaagaagtagatggagtattattttcttactcctgatgtgtctcccaggctggatgatgacaaagaacaaaggagaagttgtcaggctcagtcaaggagaagggaggagcgatatggtttaagtgtgggaggaagagaattgaagggacatttgtgccactttacgcacccacagagctgtttgtgtaggtgggggctgggcagggagtgtcaccagagactttgacttctctgcctcagaacttcactcagtggggtgtctgtgtgcctcagattaatgtcagcctgctcagggagaagcaaatatgtgtcctctgagggataaggcacatatttcacataccctctgttctggatggagctgagctcaagggactgggtggagaggaggtcctcttctctcaaacatggcccttctttctcgcagccatacttttgctaatcccctctctctggaatagttttcttattcctttctccctcaattatcattttactccttttaaagtctacctggtcttcatagatgaacccagagcttatcttttctctgcagatttcttggtcacccaaatagtggtaatttttcttctgaacgcccctagcacttactgtccatatcacttctgtgtcatgtataacagaatagcagatggaggaagctcagtgtttttgtgtctcatatacataggcaacttccatattattgttctgtatgttatcttgtctccccaaatacagccccaatgtgtcaattcttaccatgtctgctacagttcctaggggattttgcagggggaaagaagtgagttgtcatgtaaatgaaataatggtgtaccttgactgaggatgtgagagaattttttgtgcatccctgggcacacagctgtcttagtctcttgtgcccctataacagagtacctgagactgagtaacttataaagaacagaaatttgtttctcgcagttctggagactgaatgtccaagatcaaagtactggtgggtttggtgtcccataccagctggttatctgtttccaagatggcatcttgtagctgcatcctccgttggtggaagtgatggaaggaaggtcaataaggccctacctagttccctccagcccttttataaggtcactaatcccattcatgagagctctgccctcatgacttaatcatctcctaaaggatccacctcttaatgctatcacaatggtgatgaagtttcaacatatgaatttgggggcacacattcaggccatagcagcagccttatatgggaactgacaatattgtctctaccggggctgtcctctatatagaaatataacaggagccacatgtataattttaccttttctactagccacagtaaaaaagtagaaaaacaggtgaaataattttaatgtattttatttaacctagtatatcccaaacgtcattttaatacataatcaatgtacaaaaaaagtttttttttttttcgagatggagtctcgctctgttgctcaggctggagtgcagtggcacaatcttggctctctgaaacctctgcctcctgggttcaagcaattctccggctttagtctcctgagtagctgggattacaggagtgtgccaccacacccagctaattttttgtatttttagtagagacagggtttcaccattttggccaggcttgtcttgaactcctgacctcagatgatctgcctgcctcagcctcccaaagtgcagggattacaggcatgagccaccacacccgatccaatgtacaaaaatattaatgagatatgctactgtcctttattttatactaagtctttactaactgatgtgtattttacgcttacaggacactgcagctcagactagctgcacttcaagtgtttaatacttacatggggctagaagctgccatgttggagagaataggccctgcattcttgatccttagtctaacaggagcctcttagggatcttctgattattccaggaagaagcaagaaaggttacagggttgtgtttcatgtattaggaggcaaattaaagctttaagagaatagaaacagagaatttaccaatgaggtgcacttaacttttttctcccttagttttcttcccatattcacatttaccacagaaaggagaaacaggaaaaatttacaacagaaaggagaaactcaccaagtacttacgcaaatacaagtagcgcatgggatgcattctttttcttctgtcctgtgcacctgccttaccttttcccagggtgagtggatgatagcgtggcatctttgcaggaagagcttgtagagaagaaatggtgattccagccacctcagcctctgcttctgatagcctcttgctttgttcctgaagttaaataaccaaaatatatgcttataaagtggtgatgaaaaattacttcttggtcagtaggtgtctctgatggcagcaaatccatgttgcatttgtctttttctcttaataaaggacttgatggactgtgacaagattggccacctattttagagtcattggaattaaattaagacatgcccacactacctaatttcataagggtggtgctggagggagaagaggatagtacatacagaaggaagagggtggcccaatatcgacatgttaatacccaggactaaaaacaaagtctctactgttataaaggccaggaaggatgttctctttctacccaggcaaacactgtccaaattttatccacaggaaaatcaaggctcagttattcattgtgtacagctgcagaaacaatagaaaatatagccccttggttatcagagcagcattatccaaataaaattatcaggctcaatgtagccttgactgaaatgtgtggaggtaacatgctgcttttgttcttctcaaacaatgtatgaaccatagtcgatttatttttcctagtcctggttctgttagtgcctgagtggccttgagcaaagcactgtctctgtggctcaacttctgaatttatgaaatgggtccaggaacacctttcacacctatatcccagcattatgatgtgaaaagcagcctaaaaattaagcgctacattgctatgaattgtaaagtgtggaaacatggaataaaatacctcttaagctccattgtttattatgaaaaacattttcagtagtaggaacagctgtgaatcaggcagcccaacttaattagagtcaaagaatgtgcgccttcagctgctttttattgatagtgtttgcacgtttacttcctgaatagcataaatagaggtggagtaggtttatgcagggaagaataagtacattggaacaacctagaagtggaatcttccttctgtaaacaatattctcaataccagatacaggcccctctgttgtagcaccgggagagtaggagacctctttttaaacctagaagtatatgcatgtggttaattatacatttacaaggtaaagaaagcatccatcaaggaaatacttggagcaatattggcccagcaaattcagcttttaaatataattcgtattggaacaactggcatctccttcagaaagaaaaataaggtggtcaaaatgttgattctctaacctaccatcttggatagggctggatgttaagtcactggctcttacaggtgatgtgggcagcacgtagactgggtgttttcgagtcaagcacataaaaggctgcaggttttctcctggccacccggagcactgcagtaggacggcacctctcctgaaataaagctaatttaggctcacctcagctcccccatgggttgggatatgtgtgtgtctgctcttgctaagtgccagatttataattttgttctcttatgctagtcctgcagcctcttctttccatccccaccccatgccagccaagcagaattggggggatggggagaggactctaaacagacagctccttagcctctcagaggcccctgggaagagccacaggataggcaagggtcaagggaataatagcttttccttcttcctgagaagccttctagaattcccctaaagaactaggggacgcaatgtgaatcaaatagagaagccttcctgacttcaggatgttagggatacacattttttgagggcggagactctcattgttcatttttttttttcctgtccagcaggttctcggtgtggtggttaaaatgacttccagcttgggccccagacatttctttggaagaatcttgctttaaaacctaaatttaagctaagccccatagaaagagcaaacgaaacttcaaagaactcaaaatagagcatgtaatttcatgtgttgtgaaggcttatgaggaaagtggctttagtcaggtgtcaacaccttctcagggttacaaggaataacctagtccagctgccattgcagatgtgggggcgcaggttgtgacaggtggcccctcaggtggggagggctgtcttagtgctagctggtctccacttgtctgttctgcttcccacttgagagtactgtgttcattcctcctttatggggtgttcccccatcatgtttttaagtgtcagaatgttgggcagagggttcttttctgcatcatcctataaagcaatcactaaatatatcgggctatgaagcacttttcctttaaaaaaaatttttttttctttagaaacggggtctttatgtaacaaacctgcacgttgtgcacatgtaccctagaactgaaagtataataaaaaaattaaaaaaagaaacggggttttgctctgtcaccaaggctggagtgcagtggctcaatcattaatcactgcagctttgacctcctggactcaagcagtcctcccacttcagcctccaaaagcactgggattacaggtggcctcatttctctctctctctctctttttgttattgttgttattgttgttgttgagacggggtctcactctgtcacccaggctggagtgcagtggcatgatcacgactcattgcagacctgacctgggctgaagggatcctccggcctcagccttgtgagtagctgggactacaggtgtatgccaccatgcctggctatgcttttaattttttgaagcaacagagtcttcctgtgttgcccagtctggtctccagctcctaagcaatcctctgacttggcctcccaaagtgctgggaggtgtgagctatggtgtccagccttcttttttcaaaatcattttcatacctgctttccctataacacctcgaggtagggtgcgaatgggcacagagggaagagagctgagcctatatccagagcccaggccagaacccaattctctggatgaccatgcttcttcggtaagtatatttttgtggaatatttggagctcttttgacacataaagatttactaaacaacatattcacatatggcaaaatattatctataaatagcttcaaaatgtctttgctttagttttaggttctgatttgctgtggtgtagtgaggacagaatttttcttttgctgtattttaattgcaatagcgagtaaacaaaccttttttccccccttggttatacttttctttggtttccttggagttttccttggttacattgaaaaccacccagtatttgcatttgcatgggttagttcttaaagtcctaagtgggtcctagtgtttggaggttttgtagaaatcatatctttgtgtagtacaggccacacatggggagttgaatgtccatgtagtcattggagaagtggccagagttgggtgtcagagctgctgtttggacttggacagatcctgagtgtgtcatccttggccaggcactcattctgtacagccccccaggtgtggctctagggagagagcaggtatgcactgctgggtctgtcctgttctctgtagcttctggatgggaggaagggtgaccttttccaattgtattttatatatttgacatatttcaagtacattttaactttgagtcttaattttatttttttccacagctttagtaggaagattttcaatgacttcctcagcacatacaatttttctggttttaatttttgtaaaaacttgatccttgatgtttagattcacctttttctccccttaaaaatccagccaagggccaattaatgatagttgctatggtaactttggtgaaattcagaatgttcctaatgcaaagagcaatatgcttgaacagtagatttcatttaaaatgtagaagaagaatttgctttggtataaaggtgttcagctgaaccttcatgaagaaagttgccaaggactgaaagtgcaaaaggttatagtttgaaaagcttatcatgggaatttttagccatcttttaaataaataaatctcatttggttgcagcatgtttgccctgtacataaataaagcttagattttgtttgggtctccaaaacatggatttaaaattctgcccagttttatgtcccctcatcaaatgattttaccatgtattagattataatgttagtgatgtttctggcttatattaatatactgctttatgttgaaataaactcattttcatcctcaacacataaatttcatcaatttcagaccttaagcacggttatcaacctgttagatgcttctatttgactttgcttaaatagcgctgaaggcctgtcagatgactagggggaagtttttcctaaacaaattcaagttattttgccaattcagtgattttttttttaaaaaaggatttctttaataaaatgaatgttatcacacccttaaaagtgacaacacccatgtaaaagaagctgattgtatatctaaatatcataaaaaagatcattgaatttaaacttcttcagagttttgttttgttttgttttgtttgacactgtagccaccattacaagctcagttataagtaataagtgaactgtttctcatttattttcctttttatatctgtcctaggcacattttcttacctaggagtttactaatcatttaacctgaggactatctagaatatatgatgtttaatattttagtcacctgcatttatcataactgagcatttgatccatgccaaacactgttttaagcacaatagtgtttttttaatgtaatatataatagtgacatttttacacactttgattgctgtgtaaatgtttattggtatttctttctttcttttttttttttttgagatggaggcttgctctgtcacccaggctggagtgcagtggcacaatctcagctcgctgcaacctccgcctcccaggttcaagcagttttcctgcctcaacctcctgagtagctgggattacaggtgcccaccaccacgcccagctaatttttggatttttagtcgagacagggtttcaccatgttggccaggctggtctcaaactcctgaccttgtgatctgcccaccttggcttcccaaagtgctgggattacaggcgtgagccaccgcgtctattggtactccatattgtcagtttgaatggggggatgtggatgcggatcttacacttaggatcactgtaagaaaaaagtttatctttatagtattatttattaattgaagttggcttttatttgtacattggtatgcaaattcaagtttgtagatgttgcaaagtggatattggagtctagccattctaacacttcatcataaggcagcttccctcctccacttcaccacccctccaggcagatctgcatgcagtggtgctcaggcacatgtatgtgcttttttttatgcagcgaggttagagaatggggggcagggtcttttcctacatggggtaggggtgcattggccagacactgcatctgtctgttctccactctgtcctggcacagctcacctccagaacacagagcccaaagctgtcctgaagcagtgggtcagaaaacatgtttgaatactcagacacatggaatatgtccagtccttttcaaaattcaaaatggtagaaccatattgggaagccatgactggggacaaggaataagctttatcaggccctagtcagaaaggagtttagggctgactggagttgtaggacatgggagcctatcctcacatctggggatcaccccttgccgttcatgtgaccttgaatgatcactgagcctctcatctgtggttttcttggggaatgataccaagtcataggactgctgtgagcactggatgtaataatggatacaaaaactgttttagcagtgagcacagtttccttgggacttggtaactgatagctgtcaattcctaatcctcatttaaattattataaatgtgaggtgaagggaaggagaaattcttgttagtgagaaattagcttactctttggcatcaaagtgtgacatttgtctgtggtatctgttaatcaagttctattgatcaagctaaggtcagatccttctcttatagattaaatattctttttttaaaaaaattattggttgtttttttcttggttttcagtttataatgaatgcctatcttttaagattgacctaggggagcagtgtaggataaaatatcaagttccctgcgaaagattctgtgcttctgaataacaataaactacaaggtcaactttctagaataaaattcttctgatctaaaaacatatccatttggggaaaggtcagagaaactgagattcaataattcatcttttgagggttcatcttgtttatgcgagtcatttctttgaacagtttgatcaggttttgcttcagtaagggaggtacgaagatacaaggtacgtgttgcctcaaggagagaggttgtaggtttgccctttccctgtaatggccggactaatccaccagcttatattaggaagattagccatctgttagcttctaaaacagaggcaaaagtttctgctttcagattctcttggtgtgcgggcttgggaaggacagatgggagctaataaatatcataccttgaaaggccaagcacccggctgagttgtcctatccactgttaagtccagcccccacagcagtcctgtgatgtaggtgttgttcctcccttcaggtaggaggttcagtaatcattcagggtcacacgactggaaaaggctgaccccagatgtaaagccaggctcccagctccttgttcttccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatctcctgattacaactctatagttttgtctactagagctgacacctttgttttctgtcacttctcaggccaagaagtaactttttttaggaaaatatctttttccagtaaagatgtcctttcatctcgccaccccacccccatccctgacctcttctacatgcagtcttttttgtttttgttgtttgtttgtttgttttttagatggagtctcgctctgtcccccaggctggagtgcagtggcacaatctcggctcattgcaacctccgcctcccaggttcaagcaattcttgtgcctcggcctcccaagtagctggggctacaggtgcacacctccatgccaggctaactcttttggatttttttagtagagatggggtttcaccattgttggccaggctggtctacaacacctgacctcacgtgatccatccgccttggcctcccaaagtgctgggattacaggcgtgagtcaccatgtccagcccacatacacttttaaaaataatagtttatcttgataaaatctgaattaagctgttgtttttatgaggattgtttctgactcctgtttctcatttcccttttcacctcccctgtcagacacatacactccacgtccacaccacacatatgcacactgcggacttcaccactcacattcactttactttgttaatctggctgcaaggaaatttcttagcccttgacacagtatgtgaagagagttctgttggcagctcaccatggtatttcaaatgtgtgcctcaaattgagagtgccggttggaaataacaattcactctaagcagtgcttttcattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgcagtattctcaggaattttaccagtgtgggattgctggtactttgaggggagaaggataacttcatatctggatttaatttctgagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactatataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaataccattatgttaaaaaaaaatactatggaatctgtgtggcagaatgtatttaagctgaacagattaaggctgtaggaccaaagggctgaacaaccttgagcatttttctttaaatattcaagtttaaaagcatattccttggcacccctaaaaggaaagcccagtaaaatgaatatgacatttagaatatgtagcattggagattttcatcttttttttttttttttttttgagtccttgggtttatcagctggaaactttcatggcattattgcatctttacatagtaataaatgtgtcataattgacatgtgctttaaaatgctctcacttcctctacttcctggaagattgtttctgtcttgcatgttgtccttgctgtgttttatgatgtgtttgtataaacatgatgaaactattcatgttcttgttgatgcttctctgaatggttagcactggctctctgggtgtgttttgtttgctaaaccttgaaaaagtcttagtagatggaatacagtggaaagattaggaagatgcctttttccctcatacttcctttaattaaataatgtgaaaatatactgatttaatagatgtttctgtgagttgtgctaaatagaattggtaacagtgttacagttttatagggctttttatctgtttgagaggtatgcaggatttcttttttattattattttttattttttgtagagataagatttcactatattttccaggctggtctcaaactcttgggctcaagtgatcctcccacctcggcctcccaaagtgctgggattacaggcgtgagccaccgcacctggccgatatgcaggatttcttgatgtttctcatcttcccataacttttctcttttcctgacatgtgcttttagcctctgatagccgtcagcaaatacctggctcctgttggttgttcagtcctctttttctcttctctcacatacctaccaccctccaggcaaagcaagtaccctgtggttctctgcctaatttatatgtctcggaacatgctgctcccctcaccttaaatgccctgcataactcacaagactcttaggacctttgagttgtaccttcatctccagaagttctccctggcatttgttctgcacctcccatggctccacatgcccagagttactgatttgtctcctctcgattctcctggaacacccagtccacctttttttttggtttgctcacctgccatctcccatgtcatagaaaggctgcagtgagacacagccctgttcatgaccttagtaataacatcataagcaggttatcagtaaatgttgatcaactgtatgaatctgctgaggttgtgaaaagggattcggagaagtttgagatgcatttggccccagtagttcttacctagggtggggaaatcaggcatgtacctgaggaaggttgctgtgctgctaggcagaggagttgtgaagtgaaacagagcacagcatgcacctgtggactgctttcaggccatgttctctggagtgtgaggtgccggacggctcaggcctcctgtccctggaaggcagagtgggagcaagcatcttgctggtagcggtcagaggctaaagggaaaggtagcactgggatattgccttaagatgaataggatttccataagctggggtgaaggaacgaggaggagcacaaggaaaagattagcattgagaaggagcaaggtatttgggcaaaaggttggagcagagatttcctgttctggaattagcagtgggagggaaggaagaaaggaatcccagaagccagttacggagagccttgattgctaggctaaagatatttgggtgttatcctgacgtacagaagagtgtgtgaaggttttgtaactttgaagaaatgggagcaaacagtctagtgatgaaagcagaggaatactgggcagagaaggagacttttgcagtagtctaggcagggagcatcctgacccaagacacagtccgctcttcactcatcctacaaagtgagtcccatgtgccaggccatggagagtctgtgatgagtagtgtcccttgaggagaaaggggcatgaaaacaaaatcaccttagttgtcacgtttctagtgagaagattccaacctgaaggaaaatccataggaggtgataaggatgctggttgactgatatgcgtaccagcatagtcacaggatgtgcagatcgtggattgcagatctgggctttgttcacagtgaaacaaacaatgctgcctgtgctgctctagtcacttaaccggacatctccctgatgctgtcaacttcagtcccttttaactggtctcctgctgcttcccttgtccccacttgctctgttctcaacatggcagccagggtgatccatttaaatcttaagtcagatcgcgtcacttctcttccccacactcacggtggctctcgtcgcacccagagtaaaagccaaagtcctcatgaagatccacagggccccgcccgcccctcaccacccctctggcctcatctcctgctcagcccagccactctgagcacactggcctccttgctgttcctctcacccctataaagctccccaaggcccctccttccctgtgtgtctccatgtctgatttctcacctctttgaagtctgctgaagtgtcactgaccaccctatttacaattgtaacctgtcccccagccctaaccctggcccttctgacccctctgaccctgtcctaccttttgttgtcatgactgattaccttctgccatgatgtgtcatttgctgttgtttcttgtcagatcctccacactgctccccccaccccataggtggctctttttttggaattaattaatttagtgattttttttctttttatttggtaggctctttaaggcaggaatcagcttctgttttgtttaacgatgtgtctcaaatgtctagaacagtgcctggtacaaagaagaagctcagtcaatatttgtcgaatgatttgtaatttatttgctcttactagtacggcctagttaacttttccccactaccaagtggattttgtttatgagaaagaaaggttgatcctgtcacagcctaaattccaaatatagttgccccttggtatcctcggggaattggctccaggagcccccacagatgctccagtccatgctataatgtgatgtagtatttgcatataacctatgcacatcttcccatatatgctagatcatctctagattatttataatacctaatgtaatgtaaatgttatgtaaatagttgttctactgtgttgttctttaaatttgtattttttttattgttgtcttgttagttttgatctgcagttggttgaatccacagatgcagaacccacagatacgaagggccaggtgtatattttacctgttatttgttttcttcaaatgacgtattttctctttgaaattcttagagcagagttctataaaatgggcacaataattagaaaagaaaatttgaaagcgacttttcaaataaaagaaatgtggcaaaagggttcagtcacatattagaaacgatttgtaatctgcaaggctaaagtggaggataaaaatgttgtaaccagaggataaggtccactggttctctggcttgcatggtctgggtgcattccacttattcctaacaacagtgacaagttctccatcattattatcttgggggaatttcagatacccccacaattgtacatgccctcagcattctgttgcctcttaattcgagaactaaacacacacagcacaaaatgctaaataaaagcacatgatagaatacaagatggaaaagaataattcctaaaaggaccacaccgcagaaggtttttagttttttgttgttgttgttttttgttttgttttgttttgttttgttttggtcttgtcacctagcctgtttttttcctgtgcacacatgcatcattgacatacacatatacactcaaccctccttgtccctacctcctccccattaaagaaagctgttgaagaagattcaggaaatcagaacagagaacgtcgacatgtgcaaacctttggataacttttaattagctagcctgccatcttataagtaactttcaaaagtgaattgggacctttttaaattcccagctggaaagtttccatttagactgtgagggtgttttcttttcattacataacccatttgtcagtggaggcagtatctccctgcaggaggtaaacattggttcttagaaggcaaaaataaataaataaatacataaatacataaattttaaaaaccctatttaaatgtataaagcacagatatacatacctatatataaaagatatacaataaatagatatacaatatatctatgttataaaaatatcctcagggtgagtacagtaatgaaaatggttgagaagcactggttgaacccacactcagaggcaccagcctagagcacaaacggtctgctctgcatgttcatgcttttacgtggtgtttgatagtttaacagtgagctgtgtccaagggcatgagcctgttaggtaggacatggacttatcatgatcaatttggtctattaggcactttttggttagagggacagaattgctcaggtgactcagttcctggagggcagagggaaggccttgctgggctgccagggaccagctggcaggagtagagtctgggaaggagaagggtgtttgaaatgagtataaccatcatccctctcctcacaggaccattgtggggtagtgtgttaattcattcttgagtcactataaagaaatacctgaggctgagtaatgtataaagaaaagaggtctaatggcctcatggttctgcaggcaatgcaggaagcacggtgcttgcatctgcttctggagagggcctcagggaacttacaatcatggcggaaggtgaagaggtagcctgtgtaccacatggcaggagagggagagagaagggggaggtcccagctcaaacaaccagatcttgcatgaactacctgggtgagaactcacttatcaccaaggggatggcacaaagccattcttgagggatctgcctccatcatccaatcacctcccaccaggccccacctccaacaccgggaatcacatttcaacatgagatttggagaggacagacatccaaaccgtatcaggtagtgttgaggttgttgaggtaagtgtatacaaagctcttagcacagagtgaagctcagtgaacaaatggctcttcttatgaagagcagccctcagcggaggcatggcacttccttcaagagaaccaaacttggaaaccttgaattaggaagtgattactcactttacagggaatgactacggtaatgatatatttgctttctgttacctaaacttagcagcttacatatttatcatctaatggtttctttagctcagaaatgtgggcatagctttatgggtcctctacttagggtctctcaaggctgccttaaagtgttgactgggactgggttctcatctgtaggctcagctagaaaggcatctggttccttgctcatgtggcggtcagcaacactgtatttcctggggttgaaggattcataggagcttgcacttgaaagccagcaagaaaggagagtgagaaagacaaagcacaagtctgccagtaagacagagtctcatatgatgcaaggtaatcacaagagtacagtctgtcccccttgccatctactgttgggtagaggcaaatcacaggttctgtctgtactcagggagaggggcctacacgaaggtgtgaacattgttgggggatcatgcggagggagtctgtttgctacaaatggtattcatattcacatgtgtttcaaacagtagaggaaaacgtaccaaatatttttctttctttctgtctctttctttctttctttctttcttttctttctttctttctttctttctttctttctttctttctttctttctttctttctttctttctttctctttctttctttctctttctttctttctttttcttttctttcatttattttttgagatagagtcttgctctgttgcccaggctgcagtgcagtggcacgatctcagctcactgcaacctctgcctcctgtgttcaagcgattctcctgtctctgcctcctgagtagctgggattacaggcacatgccaccacacccagctaatttttgtatttttagtagagacagggttttaccgtgttggtcaggctggtcttgaactcctgacctcatgatccacccacctcagcctctcaaagtgctgggattacaggcatgagccactgcgcccggcccaaatctttctattagcaaaacatttggttgataaaaatattggcttatattttaataatactgattggaaagcaagataaaggcactttgtgctgcctgatattaactgttaacagccactaatgctgccttctgcggtttggagtttattgaggacacagccctcttctttgaaaacgtggctgtctgatatcttccaaccaagggagcttttcaggacctcaaaacttcttgctttgtaaggaataattgaaatatccctgcaaaggtgattttaaaaaaatcttttctaaaatgtaaaactttcttttattatttgtgcaatgtttataataagtactcatttcagtgaagataaccattgctttgtttcactcagattcattgtcaagctttaaactttcatttgttttctaaattgaaaaaagccatttttggattgttcttacactggcattcttaaatgagaagtttggcacttcgtattctctactgggctccccctccttacactagcttggagttatgctcagtcagctctcctctgtatgggagaatgttgaggaacaatgctgagaattatatgggtattgcaaacgacaaagtgagagtgctgttggagattacgataccacaatgcaaaacaatttaatggtttggaggtacatttgtaagatgacaaggaaggatgattgaccacacccttaaccaagggttaagaggccctgaagaatatttggaacctttttttctgctgtacacaggtgtactggccaccacctatggcccttgaagtggggagaggttggtgttttggtgattagactttgaaatattttatgattccatgtactcagcatatcctaagtttctggctcactgaaaaaacttagcaaggcattgttaagttatgggcttcttacagtttggaactcccggataaggaaaaaacaaacattctaactgtctcacaatagtaagagcaaaaagcctgtgcagtccccaccatggacattgtgattgtgcatgacatacatattcaaatttagaacggagagatgcttcagcattctcttggaccaattgtttttcagaatgcagggttgaataaacaagtatctacatatttccactcttctgaatgccacatatttgcataatgctggacttttcaatgtttttgtagttcttcttcattgaatgcatccaaattgtgggaatgtggcagatggtgttatatccatttgacagatgaggaaactgaggctcaataacttgacttgcctgaggtcatgtcacacttctgtagcagagacagaaacagagccaagccctcctcattccaaacctcaggcaggagctgtggtgaaaagcagggagtcggtttgcatcttggctctttcatatgccagcattgtgaccttgggctgttactgaacttcaaagcctcagttttctcctttgtgaaatagggagactcccttctcttagggtttttagggttaaatgaaaatttacaaccgtccctaaaccttgcaagcactcagtaaatggcagctactgatgtggtttatgttggttttggcatactgctatttgcacaactgggtgttagttgagcttacctggtgtatctccttaaggcccattggatctgagtatctggcattctaggcccataattcagaatcagtggaagagacaatgttgatacatctctgaggcttggttacctgggagctggcttgatgtctggggttctagatagtgcccccaacaggagagttgttacggggtgggatgaggggctttgcccgcaagaggatgaaaagaaaatagtagaaacaggagagtggcttttgggcaaactcttggatttgctgttcagacatattagcaattcgtttagtgaagaacagagcagggatgtgtgatgggcttccattactgtgacatcaaggatttgaattctgaccacctggcagggaatttgggttctaatttgccaccagtggagatagcacaattatgattgtcttaacacaagaagccgtctcccctaacctactctcaaaatctatctcaggtactaacgctgacacagatctgctgccataaacttggttgtcttttttgtgctggagagggtttcttctgaaatgtaagcacctgggctcactctttctgcccctctgtctttgaatcagacagcagctttacctcttggcctcttagcagatttattcttaagcaatattaaaagtattgttgcttcttgtccaaatctcctttccccattcagaaataaaacaactcccttaaaggggagagataccatcacctccctacttggggcctgagaggtgttgcagaaaataaaattctctgagctctttgggccaattgttccttagattttaataccttagcatgttgtctgtgcagttttttaaagcatggcatcacacacatacccagcagcatttgatgaaaggctccagtttcaaggtaagatagtagtgtcaagctgtgcaaaatggttagtcggcctactaactcaactctggagcaagctgcttaacctttttaagctacctgtaaaatgagaataagaagagctgcctcacagaattgttaccaagagaataggctcacagtaagaactcaattgttaatttccttaaaaaaaaatcctgctggggcctggtggctcatgcctgtgatcccaacactttgggaggccaaggcaagaggattgcttgagcccaggagttcaagaccagcctgggaagcatagtgaaacctcatccctaaaaaaaaaagacaaaaattaactgggtgtggtggcatgcacttgtagtcccagctacctgggaggctgagtcaggaagattgcttgagcgtgggaggttgaggttgcagggagctgtgattacaccattgtactccaacctaggtgacagagagagaccctgtctcaacaaaatgaatgaatgaataaataaataaaatctattgaaagggggaaaaaaagcctcgaagaactttatttactttcttctgttgcatgctaccacttcctgaaagaatagacatttcccaatctcccaagtaattaaaaatgaatgcagatactgatttagagtggctgcatttgttcattggtagaggtagggacctaagaaacggagatgttcttcccatagctagactgtgtggctaagcatagcattgctataacttaaaatttttttcttatccattgtaaaaagcttataaaatatagaaatgcataaaaaataaattccatttacagccttactctatagaagtagtaagacattttggtgtctttgctctttctttttaacttagatttgtgtgtgaaatagatcatgtctacgaaagtgcatggaacatatatgtatgaattaaggaatactaaatatacgggtaccactttccaatttaagagctagcacattgctagtctctatgagccccttttgtgcctggctcttccatttattattatttttttctagaatcaagttagttctgtttatgtagttttatattgtgtttttgttcctactgtatcataagtatttttcaataatgtcatcattttaggttgctttcttatctttagagctcaaggtaattacagatcatagaatagcctttccggtaccgtgccttatatactcatttaattttacaacatgctgtgagctgcagcagctccccattttacagatgtgaaacctacatttcagaatgtttaggtaaattgccttgatgacagagtatgccaaaggactgagattagagtccaagtctgtgtttccaaaacccttgccatttctaccatggacaggctgactttatggggctgtatgttggaggcaccgtgtacatttaaggaattgaccattaaatgtgatgatgacgttatgggaacttgcttaatgataaagtaggaacaaaaacacagtccgaaactacataaacagaaatatagtatttctgcctaattctaaacaagaataacacatgactaagttctagtttttaagtggtactggtgccagaaaattccagatgaaggcaagcttccacaaggaatgtggaaaaacaaaaataatttcttgaccaggttcagtgactcatgcttgtaatcctagccctttgggaagctgaggtgggggggcatcacttgagctcagaagttcaagaacagcctgggcaacatagtaagaacccccggctctatttttaattttaaaagaatattaaaaataataaactataaaggaaaataactttttgagaatcggaacagtattgcatgctctgcttttatttgaagagtctatagtgttgggttgtctggtgttcccccttatcctcccttaattcccccaccttcctcccaccccataccactatgaagtgaagtctgagcttttatgttctaagcagccctcctgctgcattttctttttccttttcttttttttttttttccttgagacagtttcactcttgtcacccaggctggagtgtaatggcacgatctcggctcactgcaacctccgcctcctgggttcaagtgattctcctgcctcagcctcccaagtagctgggattacaggcatgcaccaccacacctggctaattttgtgtttttcgtagaggcgggggtttcaccatgttggtccgggtggtctcgaactcctgacctcaggtgatccacccacctcggcctcccaaagtgctggtattacaggtgtgagccaccgctcctggcccctgctgcattttctacagttgtacagttgtgcatctgtgattgattgtgctacaacctgggaggaagccactctcctcctttgctttgcccatgaagacgtggccctgtaaagtctagaagaataaaatggttgctatggttgctgtggcagctacaatgccaagctgaaaagctgactagaaagtcgcctgcttatctttggaaagagaggggactccatttggcacagatacagttgctcattatattctgcaggtatagtcactgtggcatccttgggcacattctgcgaactcaaagatgtgtagagatttggaagatgaataaaaggctgtgtttgtttaggtggaagtatggctgttattaagtttagtgagatggtagtggttaacctcaccaaagtattcattaatataagcatcaccttcagctttgccacagtgttttttggggataggaaaattccctgcctgtgaccagtgaatagtaaaacactactgggattttttcaaatggccattaaatgccaacagccaccaccacttgctgagggacaataaaaggagtggaggaaggcagtcagtcactttgtgtatgtttgaattcttacactgtaggtgtccaacctaaatagtgctgtcattggttttagttcagttaatcatgcctgaattaaaatagatttttttaaaactgtgattgtgggaatagtgcaacataaaatagttttatgaggccctacttcatgtctaaagtgtaaaacaatttgtttcaaaagaagagaatttaaaaacattttctttatttttaatacagggtcttactctgttgcccaagctggagtccagtggtgcagtcatagcttgctgcagcctggaattcctgggctcaagtgatcctcccacctcagcctcccaagtagctgggactataggcatgcaccaccacagctggctatttttttttttttaattcttggtagagagagagggttctctttatgttgcccaggctagtcttgaactgccaggctcaagtgatcctccttgcttcagcctcccaaagtgctgtgattacaggcatgagacaccatgcccgacctccaaatattttcttatgataggttactcctggaagcaataaatatgatgtaaagctcagattgactttttaattatctttatttttaaattttgcttttaaatttccttttctttttcttttcttttctttttttttttttttttgagacggagtttggtcttgttgcccaggctggagtgcaatggtgcgatctcagctaactgcaacctccccctcccgggttcaagcaattctcctgcctcagcctcctgagtagctgggattacaggtgcctgccatcacacctggctaatttttcatatttttagtagagatggggtttcaccatgttggccaggctggtcacaaactcctgacttcaggcgatccacctgcctcagtgtcctaaagtgctgggattacaggcatcagccaccgctcctggctgctttttaattttctaattcatttatttttattgtggtatagattgagttttgttgtcataccttcctgtgtttgtggagtcttagaaaagaactctcaggttactttttttttaaaaattttatttattttttgatacagagtttcactcttctcacccaggctggagtgtagtggcatgatctcggctcactgcaatctccgcctcttgggttcaggtgattctcctgcctcagcctcccgagttagctgggatcacaggcatgcactaccatgcccagctaatttttgtatttttagtagagacagggtttcaccatgttggccaggctagtcttgaactcctgacctcaggtgatccacccacctcagcctcccaaagtgctgggattacaggtgtgagccaccgcacctgacctcagcttacttttcttttaggccagacagatattcatttgtggagtacagatattcttctgttggttggtgctgtttagcagtatctacctagaatcttgtgtctcacaagacttgaccagattgataggcacttttcaaatgccctgctaaagctgctgaatccctgaatgatcaaagctggcactgactttggcagcggccttgacttttagagcatagcgtgctaacaaagaggagcttgcttcctccaaacagtaatagggtaatgtccagggatcagtgagcgtgttcctttcacccagtactctgcaccttgcatctcttcagcctcctgccaccttctactgttcgacacctcttgtcctggtggtgagggagcaggcagagtctttggatacagctcagctaagtggcttcaaagtcaggcaggggaactggtagctgagcctccattgcctggggttatctacttgtaaggtttttctgccttcctaattcttattactactattttactgccactctccctccatttgtgttactctgtataaccaacacctaagtgcgaaagtcctgggcttcagtctgtaccttctctatatggtatagatggatgcaggtgagatttcctgccaactcccaaatgtgtagctccagcccaggccacttccgtgagccccagatctgtgtgtgtgattgcaaactcaacattctccgccactgtgtactatttcaaactttaaatgtttaaatccaaactcattattttgtaaccctccctcctacctataagccttcccccgacaacaaaataacatatttggtctctttcacgtccttatcatgtgaaggacgctctcatccacttaactttgcaagctgggagttaataccgtaatctcttgctttccctctgtattcagtacattttatcagtttagattcttaaatctctgtccttaggcccagcatgatctagccctggcctcactcactagcctgatttccagctgtccctctctgccctgcttaggtggaccctcctccccttagaggccttacaccagcccccacttgctgaaatccaccccacctccccactgcccaccatcctcctgatttcatgttcaaaggtcatgtcctctggggaggcttcccttgatgctcaaatgaggtcagtgtctaggggggtaagctcttgtggcctgtatggcaccctcactagagtcttaagtcccacagcaataagggctttgtctttgcttacagtatatgctcagtgcctagggcagacccctcaccaggtgagcatttgacagatatttgtctagtgaaggaatgagcggatgaatgaatgagtgaatgaatgtcaggcactgtgccaagcaatttgtacacatctcatttaatccaggaaaccgtcgaaactgcaaatctcaactggggagtcaacccagagctgagccaacacccaagcccaggctctttctgctgctaccactggcttccttgagggagagacagttgctgctatttgattttactgataaaaatctgtgatgctacagggagaatggagcaggacttcttctagtagagaaattagggagacattgaggagacttgcattttaccgatgctaatttccttagggtcatttctttaagaaaaaaaaaatcctcttaagtaacaagcttggggagctgtagagctagatcagagattttgctgccaacctctaagtaacattccaagtccactttccactgcttcctgaggaggcctgtcagagttttgcaggtgtattcctgatctcctggcttggagctcttattcagtctgcttcagctcttcctctctactcttttggttcttgtctctttagaccatatttattcattcaagaaacttttacttagcacccattatgttctaggcactacgctggttgcccacctttattcctgttcctggtaagcatctccttaccattgcccctctgctcagcaacccccacacttttacaggaactatcattcattacgtaatgaggtcttgaacttatgatttaagttcaacattaattagacactttctgtgtagcagatactgtgctaggtttggaggtttaagaagagacacaccctgtgccttgaaatctgtttacactaccatcaaccacacaagaatgggcagatgaactagtgtgaagtcaggaagtatccatagttttctgtgatccacaaaagcactacagattttcaaacccctggacagctctgaggacttgatccattcgtaggtcaaacattgtacagaaagtaacccgagagagctacttgagggcaggacgaaggactgggctatttcccctctctctatcaccttcctcaccctcattctcataccctatctaagtactagttcttgccagtaagcttcttgcttccaatgtgtgaaaatgtaagcacttaatgggcaattcctaagtactactatctttttccctgaaagcagtggcatgaacttatctcaaagtttggaagttaatgggaaaaatattgaccaataggcacaaatctatgcatcttatttggatttgacataacagttaagacaactggactccaaaatagacagtaacagtgatctccagaatcaaaagtgaaaaggaaatattagagcatctacttttctaacttattgtctcaagaatttcttttttgctttatacaaaaatgtacataatattctggaactaacaagtgattatagcaagattgcaatgtaaagatgaatacataagtaaatcacattcctatatattagcaatgaacaagtagaatttgaaatgaaaacacaacacacttacatcaacacccccaaaaatgaaatactcaggtataagtctaacaaaacatgtacaagatctatgtgaggaaaactgcaaaactctgaaagaaataaaagaggaactataaatgcatgaagagatatttcatgttcacagataggaaccctccatgttgtcaagataccagttcttcccaacttgatctataggtccaaagcagtgccaatcaaaatcccagcaaataactctggatattgacaaactgactctaaagtttatagatagaggcaaagaccccgaatagccaatacaatattgaaggagaagaacaaagttggagaactgttgctatctaactttaagacttattataaatctacagcaatcaagacagtgtggtattggtgaaagaacagacaaatagatcaatggaacagaatagggatctcagaaatagacctacttaaatatagtcaactgatctttgacaaaggagcaaaggtgtgatacaaggcagaaaagataatttttttcaacgaatggtgctgaaacaactggaatccacatgcacaaaaatgaacccagacacagaccttacaaccttcacaaaaattaacataaaatgaacaagacctgaatgtaaaacacaaaactctaaaactcctagatatttattgtacatgttttgttagatttataatagaaaatctattatacatgactgtaggtttggcattgacgttatgtacaataccaaagacatgatctgtgaaagaaagaatcgataaactggacttaaattaaaattaaaaatttccgttctgtgaaaggccatgtcaagagaatgaaaagacaggccacagactgagagaaaatatttgcaaaaaagatatatctgataaaagactgtttttcaaaatatacaaataattcttaaaactaaacaataagaaaacaatctgattaaaaattgggccaatgggccaggcacggtggctcacgcctgtaattccagcactttgggaggctgaggcaggcggatcataaggtcaggagttcaagatcaacctgaccaacatggtgaaacccatctctactaaagatacaaaaattagctgggcgtggtgacacgcgcctgtagtcctagctactcaggaagctgaagcagaagaattgctcgaacctgggaggttgcagtgagccaagatcgcgccactgcaccccagcctgggtgatagagcgtgagactccttctcaaaaaaaaaaaaaaaaaaaaaaatgggccaaagatatgaacaggggctgggtgcagtggctcacacctgtaatcccagcactttgggaggctgaggcaggtggatcacttgaggtcaggagttcaagagcagcctgggcaacatggcaaaaccccatctcaactaaaaaaaatacaaaaattagctgggcatggtggcacatgactataatcccagctactcgggaggctgaggcatgagaattgctggaacccaggagagccgagatctcgccactgcactccagcctgggtgacagagccagactcccatctaaaaaaataaaaaagatatgaatggatacctcaccaaagaagatatacagatatacagatggcaaataagtatatgaaaagatgctcaatatcatatgccattagggaattacaaattaaaacagcaatgagatatcactatatacgtcttagaatggcctttatgatgggctggtacagagggtggcttccagaacccctctgaaaaccaaagatcaagtattagaatttaataaagatcagacccggtttggtggctcacccccataatcccagcactttgggaggcggaggcaagagaattgcttgagcccaggtgtttgaaaccagcctgggcaacatagtgagaccctgtctctggttttttttttgttttgttttgtttttttttttttaaagatcacgtgagaggcatacaaattcataggaaaaaatacgaaatggacaaagaacaggagtagccaattcacaaaaaagtaaaactaaaagcttccagcatgctcagttccacaaaatgacaaaaccatgcggtcccttttttctacctgttaatttagtaaaagcacaaatgcaagcatgcatacagcccctacatgtaccctctgttttaagtatcctgatcctctcggggaaataggtgtaccatgtaccatgctgatgacagtgtgctctgggggagcctttttggtaaacagtttggctgtatatatatgtgtgtgtgtgtgtgtgtgtgtgtgtgtatgtatgtatgtgtgtgcatgcttgcgtgtgtgtgtatatatatatttcatactttaatgtctgtctttaaactctgcttaagaaaaccatctcaagtgcagtaaatgccacatgtttatcatgacaccacttagtatagtgaagaatgggaaatcttaatctagccagccaatgggagtgttaggcagacttcacaaatgatgtgtagaaagactgaatagtaacactgaacaatgtttatgatcgtattgttgagtgagaaaagcaagactcaattgtaccttataaactctctcttttatagtacttgccaatttgttttttgtttgcaattccttgtcctttttttttttttgagacagagtctcactctgttgcccaggctggagtgtagtggtgcagtctcggctcactgcaagctccgcctcccggtttcacgccattcttctgcctcagcctcccgagtagactacaggtgcctgccaccatgcccggctaatttttttttgtatttttagtagagatggggtttcaccatgttagccaggatggcctcaatctcttgacctcgtgatcctcctgccttggcctcccaaagtgctgggattacaggtgtgagccactgtgcccagattccttgtcctttttaaactgtctttatgtctagacttgggagtatcctgagggcagagatgggtcataggacagaacatgagaaaagtatccgtagtacttttacccttagtagatagtcaccctcctggacctaagggtgtacctgtgggcagaatgaataataaaactttcttcccacccaacatttcctaagagctgctaatagttttccatatcttaaaattatgggaaacaatatttagagagctccttttcacactgaatagatttaaatgattaattttctttcttttttttttttttttgtttgttttttagttttttgagatagtctcactctgtcacccaggctggagtacagcagctcaatctcagctcactgtgaactccgcctcctggattcaagttattctcctgcctcggcctcctgagtagctgggattacaggcacccgccaccatgcccggctaatttttgtatttttggtagagatggagttttgccatgttggccaggctggtctcgaactcctgacctcagatgatccacccgcctcagcctcccaaaatgctggaattataggcatgagctactgtgcctggtcttaatttttatttttaaccttgttgaatgttattggatcattaagaaggttttccaatatagtattagcaactgcaataaagatgtgtctttcttgggggatgcagtgatgacggtgcagggcccatacaggcaggggtggcgcctgagggtcccgggccaggcagcagcacacaggtggcaggatccactcaggctgcatctcccgtggtgctcatctggctgctgccatctgtgctggaccccgccaaggtatagagtctcatggacacgatctggaaggacccagacagtgtgccatcgatgtcctctagatcagaggggcccagggaggtgactacttctactcctttggggactgccaccgctaaacagcctagcagcagctgcagccagactgccaagcttgtccatttcaccctctcggacctaagggtgtacctgggggcacccacaccagacttgcagtaaccacctccttggcacctgcccccacctccaagagcccagaagacacacctggcctccagcaggctgggccttccagaagggatagcagggatgcattctctttgcacctgtggggagggtctcactctgggcacccctctcaccagctgcaaggccttggactcatgctgaacagtgtgggagcctcagttccaacatctatgacagttggatcatggccttacccatgaagcattattgagagaatgaaaggagaacagagatgggcttgcagagccacatgctgctggctccacattcccaggaacaaggatcctactgcatttttgtctttatataaccctattatatggactacattctgccataaggaaaggaaaaccttggttgcgatggtttaaacaaacaagtttgtttttccacatagcatgaattccagagatgggtggctaatggtattggttcaacagctgtgtgatggtaggggtcacatctccgagatccttttgccttgccctcatttgcttgttacttcatggtcacaagatggctgccatgtctccaagaatcatgtctgtgatcaaggacaaaaggagtgggggaagaagaagggccaagctcgctggacctgtcaacttctatcaaaaagtaaaacttctgtcagaaacctgtttcctgctctctcctcctgcagattttcacttaggtgcccttggcctgagctagctaccactgcacctgtagctgtgaagaaagttaagacagtagggaacagagttgtattggttgagtagaccagtcatgttccatctactgagactggcacactgcctcctgaaataaaactggaatcccatttaaacaaaaaaaggaagtgtctttcttaaatgagtttttttttgttttgttttgttttgttttttttttttgagacggagtctcgctctgtcgcccaggctggagtgcagtggcgcgatctcggctcactgcaagctctgcctcccgggttcacaccattctcctgcctcagcctcccgagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgccaggccttaaatgagttttatacagacaattggcatatagtcctttcatcagtatccttaggtcaagattatattacattgcagattgtctccagggtactttggagatggattctaattcttattctcatattgcagtaacagggaaactgagagataggggtgtgtcagagtttgaaagacaaactatttgaagacagaaactctagtggagcttgattattagccaaaatacagaatttactattaaagaagagggtccagaatcctatcccaagaagttacttgggcatccaaaaacagatcgtaagacacattgaaagtgtggaactcagactttgtataaggcttttgtatcttgagaaggaaaatttaaaaccttaggaggattgggagcttcacgagttcatgatccttctctgcaccaagtttacacgtgctaacctttctgctttagtagctaaacttttgattccatgaaatcaaaaccttttaattgctttctctattggtgatctttaagagataacttgggcttattggtgtcagtctgtaaagaaaccaaactctgaagtgtgatactatctattgaattagacaggggaaaagctaattagtactatagtgagactggagtgcttctcagatgttacctagtggcaactgaggatgtggaagtttacagatttttagacagtctatcaaattacaattttcagaaaaaagtatttccaatgactgcaatgttttgcctctatcaactatatactatgtatgagtttttagaaatgttacttttggggctgggcgcggtggctcacgcctgtaatcccagcactttgggaggccgaggcaggcagatcacgaggtcagtagttcgagaccagcctggccaacatggcaaaaccccatctctaccaaaaatacaaaaatttgctgggcatgatggcgcacgcctgtaatcccagctactcaggaggctgaggcaggagaatcgcttgaacctagtaggtggaggttgcagtgagctgagattgtgccactgcactccagcctgggtgacagagtcagagtctgtctcaaaaagaaaaaaaaaaagaaaaaagaaaagaaatgttacttttgcactttcgtggccttggctagttttaaatgctttttcattggtagaaggcttacagagatcatgaaacattaatagttaccatttattgtgtactctttctgtgccaagtactgtgctaaatattttaggcatattatcacagtcagtccttacagcactcctttgaggaacatggcattttccccaaaatacatttttaagaacccttgagatttcaaagatcaagaccagagcaggaagggaaagctctgggtctgaaccaggtctgtctgccaccaaaacaccactcttgatagggatgatgatcttgaacagtggtaaaatctggcataattcaaacacttaaactagtttgcgtatatgtataaaattcctagaattccttataaaacacacttatgacattgaagttcagtaacttcccatgttccatataagccacagaaatattgatttgccacagtgaaagagttagtggaagctattgggccatccaaaagaagctaaggctgaaaaggctacatatggtatgattccaagtacatgacaccgtggaaaaggcaaaactacagagagtaaaaggatcagtggttgccaagggctaaggggagggagggatgaataggtggagcatggaggatttttaggaatgtgaaactattctggatgatactgtcatagtggattatacattcatcaaaatacagaatgtgcaacaccaacagtgagccatcacatgaactatggattatagttattaataacatatggatattggctcatccattgtaacaaatgctccacactaatgtaagacattaatgggcataggtgaggggctatacggaaatcctgtacttttcttttaattttcctgtaaacctaaaactgctcaaaagtctatttgttgcctttttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatctactcaccttggccttccagagtgctaggattacaggcaggattcccttcatttttaaaattactgaccccaggccacaagacatcaatcatggtaaaaattccactgtccttgatggcacacttgatattttgctagctctgtggatgagcttttccttatctgttttctctctcccattccagctgccagcatgctagctgcttacgtttggtctacccactcccagcctgtcctacctcctgccatcagattaatcttcctgaaatggagtcctgagtctatcattcccctggggaaaaacctttgttcatgctactctccctcctcggtttctccatcacctgcatcacgtggtctgtcctctctgaaatctcgttagaagcagtcattgaaatcagaagtgacctctatcatagtatgttgtttgtagcttgttgacatttgttcagacactcttgcattaaacatcacgttgtacttgcctccccctccccctcagttggactgtaggttacctgatggttaagactaagactgttttccctccaccttggtttttgaatcacctggagtgcttttaatacagtgggtccttgaaaaatgcattcagctgaattcagtgtgtctgtgttctcagtctatccagagctctgctattaggtgaaatggaagagaaactcattgcctatatgactgttattgtgacgtacagtgcaatagctgatatgtttctgacattagaatgctctcatttattggtatttgatcactggcatattatatttgggatttgtagccctactttgactgctctactatgtattgaatgaagagtttagattggtattaatatgttttaaccagtacattttaaaccagtcaaacatctaaccacatgcaaaagaagggcacgtacttatcatgcttcttcacatgcttaccatgcttgttacatgacaaagggttgcctttacctatttttccttttagaagattgaaaatatttaaatgatgctgttgttttgatcactgttttacattctttgaagattgaggaatctggtgactattttatcaagcgatttttctcctggagttttcttttttaaccttttgtggcttaattccagtaaaagattttcaagtaagtgaaaatgagttgcatatatccattaagtctttttctttatcttaagtaaaaggggagatgaagtagaaatatttagcaactcagttattgcctctagcatttaagagttcagcttgaagaaaagtagttgacttgaaagaatatgacttaaggacagaggtgagaaggagataaagaagtgcatctataggaacaaatttgtttcttatttgctttaaaaattgtttaagtaaagcacatttcaccaagttgaatttcagcttgagagatgtccagatgtgaaacggcaaaactccaaatactgcatatactgtgcttttagaaaaataaagtagtttttttgttttgttttctttttattctttaaaaatgaaggtcaagaaaaatatcagcaggaaagtcagaagtggatttagatatataaatgtcctcattgaggaacaagggggtgatctttttttttttttttttttttttgagatagagtcttactctgttacccaggctggagtgcaatggcgagatcatggctcactgcagccttgacctcccaggctcaagcaattgttccacttcagcctcttgagtagctgggactatgcgtgtgccaccatgcctggataatgtttgtgttttttacagagacggggttttgccatgttgtccaggctgtctagaactccagggcttaagcaatcctcccgcctcagcctcccagagttctgagattacaggcatgagctactacacccagccagggatgatctttttaaaaggaagtatagtttaataataatatgcagaaaataggcttaagattttagttgactataaacttaatataaatctataatgtaatgtggttgcccgaaccattcttaaaatattaggttgtttcagtatgttttactgttttgaggaaagataagcatcctattaagatttcaggtggacatactttttaagcttttgtatttgtttcacttataaaaatcatcaagctataacaaaacttaagtcaacttgtgatgtttgccttccaacagtagctgatggcatatttttttcaagttcatactggattatagttgaattaaaagttatttcttaattctccaggataatagaaacattaattgttcagagaaactccaaatataaggaactttagagaaaagatgtgtttgagtatgtgcgtgtgttgggggagggggttgccggaatacatgatggaaacttgtctaaagaattctagtgctttaactagagcagaaaatagagcagaaaatagccacagatgttaactgacggttgaacatgtgtgaattggatctttgaaaatttacacatggattttctttgcaagttatgtgcttcacagagaagaaaggtatatgttcccttttgcatgtctgcttgctttccaaagactagctgctatcttaacttaaaaaattttatttttcatgccagaaaacattgtattttaaaaattgataaagacactccatttgtaagtacttgttttaaagtaatatatctagaaggcaagatagtggccccctttcctgtcaatgtggagttccaaagcagctgaaggtagaaattaacagtcggtaagagagctatcaaaagaaaaccaggagccagagaccaactactggtagtcagtagtaattctgattgtctactcaatctgccaaggaaaactaaatacattttttcccctgagtcaggttaacacttaaagtataaaaggaagtacattcaggatctcatatgccatagttcaaaatatttttttactttatatatcatcagatacatacgtgcacacacatgtaaatatgcatcatccatgggatgtgatctcagggagataagtaccaactcatatattccttttaaacccactcaccattgccccaatttttgttccttctaactgcattcaactcttcaattcataatcatacagattcatgcaaataacagtaacgtgtttacctggttttacattctaatgttctatttctagaactgcttaaaatgttaagtagcacgcattcctgtagtcttagttactcatgagtctgagttgggaggatcgcttgaggttgaggctgcagtgagctgtgaatgtgccactgcacactagcctgggtgacaaagtgagaccctgtttcaaaaaaaaaaaaaaaaaaagtaagtatataagaaagacactgtaaagcagaagtttttcatttcttgtaagttcaccagaggagttgggaattgggaagagagttgggtagcaacaactagaagttagatccatcgcatacgagtatgcgattgttgaattacatccttacctggaaaatgagctgttgtaagggttaaatgaaaacctatctaaagcacctattttagagtaggaactcactaagatggtagggctgctgcttttataaggggactgtattagtccattttcacgctgccgataaagacatacctgagactgggcaatttacgaaataaagacgtttattttattttatttattttttgagacaagagtcttgctctatcacccaggctggagtgcagtggcatgatctcagctcactgcaacctccgcctcctgggttcaagagattcttctgtctcagcctcccaagtagttgggaccaccaggcacgcaccaccatgcccaggtaatttttctgtatttttttagtagagacggggtttcaccatgttggccgggctggtctcaaactcctgaccttaggtgatctgctcacctcggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggcaaaaatagagagcttgtgcaggagaactcctctttttaaaaccatcagatctcgtgagacttattcattatcatgagaacagcacaggaaagacttgcccccatgattcaattacctccaaccagcccctcccacaacacgtgggaattcaagataagatttgggtggggacacagccaaaccatatcagggacataagtggaagaagggatataaatagagtttaggatttcaactttgatgtatgtaagtaatggcggttcttctgggtgctgcttggcagtaattgaacggaggttatttgcccaaagtttctttgaatttatcagctatttaccaaacactattgatggagttgacaggaccacaaaaaagactcacagcattttcatctgattcctagttttcaggagaaaaattaaagttctttgggagaactttaaaatgttacatttaaatatagttaataaaaaatggcttttgggtccagtgttaacgttagtaaattaatgtgattgagtttcaagtttttggcttgtgcatgcttaaaactttgtgagtcaagaaattcctattataaatttattatcttaaaaataagatctgctcccataccagagaagatgagacaatgagtctaccatcctaacaaacccaacacagatatgtttcaaatctttttccatctctttttattatttttttaagtttacatacatgaattcattttttggtgtaaaattgcacaagttttaacttatatattcctgtaatcaccaccaccacactaaggatactaaactgctacattattcctaaaagtagcccttgtgctacttctcagtaattaagcacaaccttcctctactccaaacccttggcaactactgatctatggttttactttttccagaatatcacatgaatggattcataaagcatgtaatcttttaagactggcagcctttattcaacgtagtgcatttgagatttatccatgttgtgtgtaatgatatgttcctttttattgctggatagtattgccttggagagagataccacagtttgtttggaggacatgtgggatgttttcagttattgctgattatgaatagagctgtcatagacattcgtatacagagttttgtgtgaatatagttttttatttctatgggataagtatctagcagtactgggtcatatggaagatgtatggttaactttataataaatgaacaaaccattttccaggatggccgtgccattttgcattcgtgccagcaatatatgtgagttctatttttttctgcaacttcctcacacttgatattaagctttttgttttagccattctaacagatatgtggtagtatctcagtgtagtttattgttttgcatttttctaatggctgattattttagctatttaaactcctttgacatttcatatagaagttttatttgctcatttggtaaactatctgctcaactcttttgcccattctttaaaattcggctttcttattgttgagttctgtgagttcttcgtatatttggattcaagttctttgttggatatataaaaagcaagtattttcttttagtgtgtagcttgtctttttactcttatcagaatctttcaaagagcaaaagtctttaatttcaataaagtccaatttatctttttttttttcattaatggtttgtgcttttggtgtcatatctaaaaactctttgcctaatccaaagccacagagattccctgggtgtttttttttcccaagagttttatgttttacatgtaggtctgtaacaatttcgggttaatttttatataagatgtaaggtataagttaaggggggttttttgcctgtggatttttaattatctcagcaccacttgttgaaaagactactccttctccattgaattgcctttatacctttgtcaaaaaccagttgaccatatttagtagagacggggtttctccatgttggtcaggctggtctcgaactcccgacctcaggagatctgcccgcctcagccttccaaagtgctgggattacaagcgtgagccaccgcgcccggcgcattatagtaagtcttaaaactgggtagtatgagtactctaacttttgttttttcaaaattattttagctatttaaattcctttgccattttcatgtataaagtttattattggcttgtctatcccttgaaaaaattctgctaggattttgattggaattgcattaaatctatagatcactttgagaagtgacaactgtgttagatcttcaagtccatgaacatcataggtctctcctctttttttttttttttttttttgaaacggagtctcactctgtcacgcaggctggagtgcagtgagtggcacgatctcggctcactgccgactccgcctcccaggttcaagcgattttccttcgtcagcctcccgagtggatgggattacaggcacacgccaccatgcccggctaattttttgtatttttagtagaggcgaggtttcaccatgctggccaggctggtctcaaattccttacctcatgttccacccgcctcagcctcccaaagtactgggattacaggcatgtgccaccacgcccggcctaggtctctccttttatctagattgtctctgacttctttcatcagtgttttatagtttttatctctctttaaagttgaagaatccattgattctgatgtttgggggttttttgtttgtttttttacctttcttcctaacagaaatgttttcagaatctgatttaagtttcttttactgcagtaggtacactagaaaacataattatttgtccagatctccatcttatttagtgttggacccaggccctcaatgacagaaggtcccctttaatagggcagtgactatgtgtaccaattccacgggtctagccagcttttcataagtgacaacagaccagagagcatacttacgtcactatttcctatttctctcatctttattttcagttacagtttctgtctttggggaaaagcaggcaaaatctaatttgtaatggatagaactagctgtccacttaaacaatagaaaactgagtcataaattctgtctttataaaactcctccatacttttggaaaatgactcacttttaggcagcgtctgccatagatatttgccagaaagtgatctaacttggataagcttgatgctttgtacaagtttcagagcccctgtagagaaagctcttaggaaccagagaccatcgtgtgcctgtctgtgtcccgtgactttcagtccatcaacacacgtcactgtagcattttggaatgttctggttcagttgctctcagatgttagctacttcagaaccacctggagggcttgttagaacacagatgattgtgtaccactcccagaatttctggttctatagatctgggataggtctgagaatttacattttgaataagttccaggcattactgaggctgctagtttggggcctgcttggagatcaattcctctaatttctgtgtttgtgtcattcaaaagaattgataattaaaaaaaaaaatgcaaccaacagaatctctataaaatcatatatgtttacaattaaatcattcttacaagtaatgagatggtatggatttgttctcaagttattggatggaaacagaaacttctccactaaggagccctgtccatagctgatgtgagagagaaaacaaagctgggccacattgctttctgccttcttcttttatgtaaccaggagggagcatatccctagaatttttttttttttttctaaaggcggagtgtttctctgtcgcccagtctggagtacagtggcgcaatctcggctcactgcaacctctgcctcccaagttcaaccaattctcctacctcagcctcctgagtagctgggattataggtgcctgccatcatgccctgctaatttttgtatttttagtagagatggagtttcgccatgttggccaggctggtcttgaactccagacctcaagtgatccacccacctcggcctcccaaagtgctgggattatgggcatgagccaccgcgcctggccatttaacagcttaaggttgggtctcaagtcctatttcttacctcaaggaaatgtacgatgtttatatttatttctttcatttaggcatgctaaattctgtatattgacagcagacttaacttgaatgcagaaaggagaattcagcagcactcaaaatgaatttacaacgtgacagtgtatgattcattctaaaatgcttaccattgactaaaagctttactcctatgtaccttgatagagcagagatagtatggtagagtagaaagatcaatcattaaccaaggaaatctgttctgtgtgccttggacactcaatacaagggccttggaagccacttactttgaatatcactttagtcaggaaattgaggagtttttggaatcgatctttttaagtttctttttggccttgagattttatgtttttatgtttctatttatttctgcctaagtaaatgaccccgttttctttcttaccaccatccatccccattacaaattacatgcctttttgtaaaagatcttaacctcagaaggagaggaaatgcaatcagcaaactcacaaattttctttcagtcttaattttcttttgccttttttttttttttttttttttctgtgaggcaaggtctcactctgctgcccaggctggaatgcagtggtgtgatcatggcttactgcagcctcaacctcccatgctcaagtgattctcccagttcagcctcccaagtaactgggaccaaaggcaggcaccaccacactctgctaatttaaaaaaaaaaaattttgtaagggggagagtctctctatgctgctggggctgttcttgaactcctaggctcaagcgatcctccctcttggcttcctaaattgctgggattacagccattgaaccaccacgaccagccttaattttcactgggaaagattattgaactgtatgctgtgttcattagcaatctcgccatatcaaatttttgctacctgggttgaaacagggaatttgcatgtctttctaaaatgcatgcgtttttgtctgcagatgtcaaataggcaaggcacagctgaataagacatggaaatgtagcttgttacaagtatagtgtgtggaggaatttctaatctctttctgtccaatcagctatgcagtaagagctcagttttcatcctctagccctgaatagaatgggggcatcatcagcaatctattctggagcatacatttttaaagtgctttgaagagaaaaattttcatctactaagtagtgaagaactcctgattaataatcgcatttcttttaatttgtttaaattgagatgattaggagaaaacaaagatgggggaaagattcaggattttagagagttattacatcctgattcgggtgattatccgtactctccacctcggacacactgtgagctttatttacgtacattttgaggcagacaagattagctagatcccaggtgtccattaccctgtgaccttttaccaatacaggtaagaaatcttaaactcaagcagaaacctgtacacagctgatctctttaggagtctataaatctggggcatgtgctgtgagatgtgtgcaagccttgttgggtcactctctgttaggagaaggccccccagttaaggcaaaggacaacccaacctattcccaaattgacctgtgtagcagaatcagctttggtcttaataatgcaaggaatcaaagagcctttggtgttgaatgaagtatgctataccttagccagaagcctcacttctgacctgtgcttgatatcctgtgtattgtgacttgattatccatacatttgacttttcaagactccctgaggctgggataattagaatagcctggtaaagccatttaagagttttttaaataacaatttagggactgtagtagggttcctgttgccactgttctccaacagcacccagcatttgagaatcagttagtaccgatccgatccagtgatatataagcaaaaattctgattgtgggaaaacagaagagaaggcagtgttggctgttcaagccacatgtctaggcataaatggggaggccatgatttctcactgcttttgacatgaaaccacaaagaatgtctttgttaagaatcaaaaaacataagagttgaacaagccaaaggaagaaatgatatcatggcctagttgaatcaactaagaaatatttttatgttaaagaaattctttaaccttataactagggcattcacattcttgagtatattgagtggaagattcctctgaaaagaaagttcacatcaatagcctttgaaagatttagggaatattttgcagtgtaagattcgttatttaaaatctgaaatatatttttccttcctacgactcttctatgtgtttatagtaacatcaagacaatgacatcctgcaattgcactagaatgtattacaaatgcatgccttgtgccaatgtattcaacaaggaagctatctttttcctctgtcttattttcattgaggaaacccatgcctatgcattatgcatgcgagtctggtgtggtgtttaagtaacctcccatgggactgccgtgagactgctgtgagtctggatttgggggagagctgtgtcttggcattttcaaatataagagaaggatgttacctgatactcagagaatcttggctgaagcttggcatccctctctggattagcttagtgttgtttcatgatactattttttgttttaaccagttgtgccattgtttgctgatggaaattgttacatgccagccggcaatgctagggtttcagataaatagaatatcagcatcattcttcatatcagcaaaatgataagttgtggttttgcccatcatacttaaagctaatttaggacttaaaatctggagccatgcaaatttataagaactgcttaataggagacagtgcattagttgatttagtggttgaatttccagtgaattttttttttttaattctgtgtagggacccattttaagataatctggaaaagaagagaaccagggaggaaaatacagtgtgaggcaggctgggtggcaaaatggaaagagaggtaggctttgggattaaataaagccagtagttctcatattttctgtatggcaagagctcctttagcaggctgaaagttctgtggaacccctctcagaatatttttaaatgcataaaataagctggactacaaagaaagccagttgtattgaaaagttaccaaaatatttaagaaaacacttatggcacagtagtatgtgcttttttactaacacacaaaataacaagttctagttgtgggacctaatgacttctatagttttgaaatggtgatgggcataaatgatatttcacaattggcaacaactgtgaagtgatataaaaatacaggtatttctgttggagacaaggtcatagatactgccaatatctggtgggtggtccatacattcataattgaaggaaaatgctaaattgtagaggctaatgcaaagtaaaatgtaattattttcctgtcccagtccccaaaacaagagcttgtggatctcagattaagatcccctgggttagaagaacttggctagaatattaacatagccttttactggctgtaccaccttaggcaagttaacctcaaaaagtctatttcctcatttataaaagcgttgatgagacctactttgtacagttgtggaaaggcataggaagatcatgcctagcctcactctttgtgtacaaatgatgacttgaagcacgttaggtcttctggccagatttcttttggcagtgatagaataaaatgacacttgctacacttgctgagaggtaggggcagactttatgctaggcagggaactcaaagattacactgaaagcagaaaactcctttacctttagattttcttaagagttgtcgacccttaaggagtgtcagaagtgggatataatatggagaaaagagaaagcattataaaatatgtggaaaggagtctattaggaaatttcctcctggccttgttgatccaaagcctttagttgcaaagaaacagctttttgttcattataaatgttttaacaataactagaactggtgttgccatccaccccatttgggcatgagcttttttcttccaccggagacgtaggtccccagatgattgattggctgcaaagtatggacatgtcttgattgtttctagaaggggcgggaccactgccttcttggattgtaactactacacctgcagagccccaaaaggtctggctactctattagattaaggtttaacatgtgataatagtctagttttattacttaaggggaaactcaaaagtgtggataccttgattttgtctggatattttattaagcacatgtacctataggccataaggatgtgttctttttctggctggccactgagtgtgtctgtgcatgatgctgggcagctcttcctttctccctgacagcttttaaaggcaggatactgagtgtttgatccatcatctcagtgagggtgtgaaatcagtgaggcaatggagcttcagggtttccttgtcccttgggtcatggctaacaccccatttaatgtctccttttcatcaaaaccagatttgtcgtctcacttatttcccagtgtctggccaagatagtgatctttatgaaaacaaactggaagtaatgcaagccagaaaagatgggagagcttcgcctctgcagaaggaagctgttaaggggaacagatggagacagggtctaaacagcttcaagaaagtgtgcacttgctagtctcagaggtgctccctgtcccccaagagctgtttgaatcaggagctgcttaaggacctgaatgacttctccaactctgccagggatccttcattagccctgcacttctgagatcactcagtgccccccatagacctctcctgctcttctgaatgcagaagcaggagtgggatataaagtgaaaatatagtaaattctaacctagtgtggcttgaaaaagaagttgcaatttatagagaattgccaaatatactgtgatggatcactaattttcaacatataataatttattaaaacactaaggatgacgtctataattgtcgtattaatctctgaaggtatcaggactttacaaggttcctgtgccttggccatcattgtgatcatttatagtgactaatcaatttgacaactatgtggcatatgaatggtaagcattcttggcaagcaaagggaagaaatgtcttatctgcatttaccagatctcatgtcttggctgtttgcagttatttacccctttcttccattaatctaaacttccaagaccctaagctcacattgtatcctgtattaacttgctaactaacctcctgtttttgtggttttctttctctgatctaatcagtccaatcagaagaaagattacacttacagatgcacatgctgatgtcatgacatcatcctcttatttaaggatctccctttgcttccctatcaagtctcaacttctctggccatctagacctcaggtgaggtccttttatcttagcgaccttgttctttgattcactgacatggatcttgggcgccattaagatggtttatttgttgtcagacaccctttgttcttttctgtcctttcactgtggaatttttctcttggccaaattctatccattcttggcccacactgccttcctagcattcttgtatccctctctcactgtctcgcctgcacaatttggtatatttggtttactattggtcttctgttatttcacatattacttgtttttccagcaagtcagagttccttaatagaaagtattctgctctattttatatattataattcttagcaaagcaccagcacacagtaagtgttcaataaatatttagaggaagcaggtaaaaggtgtcatgagttagatatttcaaataggaggagatggacccttgatggggtcaaccagcatcaagtgtgcctcttttacaaaaccaggaacccaatcttctccttttttcaaagttgatccaggcttatggaattcagttcataaaaaccaagctcaagggagtgaatgccaattcaataacaatgaaaagtctaacctctaggtaacagaaatatctgtgtcagccattcattgcatcctttttcttgtagcaaggcttccagcaggcgactctagggtcattcgtggccaatatgattcatttgcaccagctctgaagcctagtgcatgccatttagactctagggacaccttgcaaagttcttgctttttactttcaccccttcctcatagatgactctttgctttttaaaggaattgaagggctattctatagacaggagtaaagcctgttcagagatgttctaaacaccagattttgtttgcttgagaagcaaagagaagataatttagacaagggcaaaagcaccatgagaagactttgaaacagttttacccaagttgtaactggagaagaagacttgatgagtcttgtgaattaggcagatagcattcatgagctggagagaatgggaaatgcagagtgcaagggagattagttttgagggagcaggtggcagtgttgagtgatgctgaggggagatcagaatgttgaaagagaagtatgactgatatctggttagtttctttgttttgtctttcttgagctgctttcaccaatgatgtacatatgaaaaagggatgttatgaataagttaccttcaaactaaattaactgagtggtttttacatggagcttcaggatatccagaagcatatgtctaggaataaaaatggttatttttgagggctgggcgcagtggctcatgcctgtaatcccagcactttgggaggcaaaggtgggcagatcatgaggtcaggagttcgagatcagcctggccaacatggtgaaaccccatctctactaaaaatacaaaaattagcctggtgtagtggcgcacgcctgtaatcccagctagtcaagaggctgaggcgggagaattgcttgaacccgggaggcgaaggctgcagtgagccgagatcgcgccactgcacttcagcctgggtgacagaccaagactccctctcggaataataataataataataataataataataataataataataataatggttatttttaaagtaatatttaatgtgaaattcataagacttgaaattgggggaaattggaagagattaattcctgtcctttgactcattgtcctttaacacagattagtatttttgcaatcttagaattatgtatttatcaggggcttctttttcctgtggacagtgtcaaggggtgttttgaagtgacttgagcccaggaagtctgtttggataaacactgatggactgatgtagaacagtttatcatctctgagcaactggtaatcactcaaacacatgtaagaagctcagtggttgctttttgcaactatcaatcatgatggttgtgtaatgcaaataggagtaaagaaggtttgattagtctgtaacagcagctggcacattttttttgtaaggggctggatggttttgtgggctgtgtggactctgtccttatagtttgaaagcagccataggccataaacaaatgtgtgcagcagagtttgaataaaactttatagaaaatgaagtttgattttcatgtaaactaatgtgttatgctattcttttttaaaaactttccagccattaaaaaatctaaaaaatatccttgacccacaggctgtatgtgccaatccctggtacataacatagaataggatgagtttcgggaagaaacagtacaaaatacaggctgctatatgtttgcaatagtgtgaaaagaaagtttacccagcgttttcttggcaactgagacttcttgtaccattcattttcaaaagtcatttcaaaaccaggaattttttcctaatttctccaaactgattatatcagctttctaaaatatttggtgtgtaatcaaagtacagttttgttgctggatttcaaaggctgcagtttagtactaggtttctcctgtttcaaaagaaattgtgttatgtacataaatatgtacgtgcacatgcacacacaggagggctctttaacaatttgaagttcttctaatttcctttttgttcactactaagtgattctttattctccatgtgtcagtttatttccagatgtacatcttagttttcttctggtaaagtcctgtttcttcctgtccttgctgatagaggaaaccacataaagcatttcttaaaattaagaaaacaatgtcacttcagctgtgaatcctgtaaactttaagaatccattcagaatgcacttgaatgggaacattttgtaaagaaagctgaaaaatggcagtcagatttttacagaacagcccaaaggggtgttttgtgtgctaatgattagaacttttgcagattcttgcttagtaattaggactgacagatgggctctgtattagtccattttgtgctgctataacaaaacacccaagactaggtaatttgtaaggaacagaaatttatttctttcagttctggaggctgggagtttcaaatcaaagtaccaggaggttagggcccagtctctctgcttccaagatggtgccttaaatgctgcatcctctggaggagaacaccatgtcctcgggtggcagaggggcagaagagagagaacctactcctgcaagcttgcctttttaattttttaattttaatgtttttagagacagggtctctgctctgttgcccatgttggagtgcaatgacatgatcatagctcactgtaacttcaaacccctaggctcaagcaatccacgtgagtagctaggactacaagtgtgtgccaccatgcccagataatttttatttatttatttatttattttgagggacagggttttgctatgttgtccaggctagctcaagctcttttgatagcagcattaatctactcatgagggttgtaccgttatgacgtcaatacctcccattaggctgcacctcccaacactgctgcattggggattaagtttccaacatgcaaatttggaggacatattcagactatagaaggctctgttcctcggaacactgtctttttaaaaagaagtgcatttaattattcaaagaatacatgattatatttttgtcttttaaaataatatggataaattgaatttctcatttgaccctgtctcctccactcaatacttcttcccttcccagagataatgtcttagtctatccaggctgctataacaaaatgtcataaactgggtggcttagaaaccacagaaatttatttctcacaattcaggagactgggaagtccaagatcaagacattggtagattcggtatctggtgagggtctacttcctcatagatggctgtctgctcacgtaatctcacctggtggacagagccagggatctctctagtgccattcatgagggctccaccctcatggcctaatggcctcccacaggccatatctcctaatactgtcatattctgggttaagattttagcataggagtttgagggggacataagcattcagttcattgcgggcaaccattgctatcaatgttttgtaatcattttctgtgtgtttatgtaaataaatgttcatgaagtatgtttcctaatagaaaccatatgagaccaggcatgctggcgcatgtctatagtcccagatactcaagaggctgaattgcgagcattgcttgaggctaggagtttgagtccagtctgggtaacataacaagaccttatcattataagatgaaaaagaaaaaaaacccatatggatgttatatcctacagattataatgaaaattgcttttttttcctacttgatccatgttggagaacacaggtcagcatttttcttttgccatgctttcctgaggattgggtgggtgggggggtagaaggtgatagaaaaccctttgcatatgatatggtggtaagacagcctcctatcctgtaggcgtggtcaaggtttaaagctgactatctcatggggtgctcatgagggttcttcaaagactctgtcatctgtgtcagtttctgggagtctaggggtccaccaccagtcctgccactgtgatcatgttgccctttcagacagccctagaggactggacctgaaacaagccctggactggctcgttcttgtcggaggaccactccgtgcccttggaaacatcaggcactctttgccccaacacccacagcctctgagaggatggcccagacccactgcagcagcaatttcccttcactcccatgccaccagggcagctagccacactgcctctcatgttccaggtccccagagaaggggtgccagcacctctctgtgtctctttaatggtggagcactcaaatcaagcccccaactggcctcactgaaatccggcttgtgaagtaagaagctgatattcctactctttccccaatgggaagagggtgctgaatggggatctcagtgcagctctttccaaagaaatcctccctcacatcttgctcttgaccctccctgtgggagaggagcttaagcctagttcttagttatctcctttttgaagggcagatgggtgttttttttttaactcactttggtatctgatattgctagcatcttgtgttagagccaaaacttgcagtgtagcatcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatttttttatttttttcttgagatggagtctcgctctgtcgcccaggcttgagtgcagtggcacgatcttggctcactgcaagctctgccccctgggttcatgccattctcctgcctcagcctcccgagtagctgggactacaggcacccaccacacctggctaattttttgtattttttagtagagacggggtttcaccgtgttagccaggatggtctcaatctcctgacctcatgatccgcctgcttcggcctcccaaagtgctgggattataggcgtgagccaccgcgcctggcttgccctattattttaaaaattgtctctatttattgatttgtaattctttatatattctgaatacgaaccctttgttacatagcaaatattttctcccagcttggccttgtcttttaactttgggaaattggactacatcaaaggcacgatgaataatgactttgtgttgtgtctggcttaaaaaggccatccttctccagggttataaacaccttctcctatatattcttctcatgctgtaatagttgacattttacagtgttttgagggttaatccatcagggatattttcatgaatagtagaactctaacttaattttttcccacatggagagctagttatttcaacactgtttgtggaaagccagtagcatggtgtgtggccactagaataagggtagtcaaagggctaaagtggctggagtggggagaatgacagataattgctaaacatcctactgatcaaggttagatgacttctcagtctagaagatacatacccttctgagaaagccccctgtaggagtgaacacccaacatcctttgaccggttttactatcagaacatttacatacaggcagaactaaaatctgtgattatctggatgagaaaacagttgtaggcaacttactcatttttctgaacaagaaaaggttctacataattacgttctctatgaatcttttatcagatttaatagttaagtctcttcaaagaacatgagatattctttttttaaagtgagcctatgatttatttatcctcattaatacttgttttccccaacccttccaagctgtttgggaatgttgtgtgtcagggatcagtgaaggtcatgaagatgcctttaaggcctgattaacctgatttgaaaaactttaaaactgaccttctctacatctccccattattgtcctacgtttcacagtcagatcaaggcttattatcctttccactggggaagtagcccaaatcatagtgtgagtgaaaaacatttactaagaagtgtgagtcttttaaaccctcttgtgtttcttttaagaaattaaaaccaataatgactatcagttgaatttggttgttccacctttattttatcaaaatccttggacatacattaaagtatttgtcccttgggcaggtgccaaggctatgaagttggagcgtggcatgttctagaagcagaaagaaggctggtgaggtagggacacagcaggtagggagtagagtgaggccaagccccaggtcagggctggacctcagggcctaggtccaggtgaaagcactgggcatgatgctgagggcagtagatgctgtgggaggattttaagcagggtgacaagatcaggcttgtactagatgagaacgttggctgtgtaaagatagattgacagtaagcaagagtgaatccagaaaaaaataatctagaaacctgttgcagtgatacaggtgagggatactttgcctttattggatttgaaagtataaaaaaaaaatgaacatctgttgtttagagtaaaagccctgtaaggtatggtataaaatgaaacattttcaaaaatgcccatgtcacaaaaaaattttttttaaatcagctctgtgcaggaccagctacctaatttgcagggccctcactgccaaatgaaaccgtgggacctcttgtgcaaaaataaaataatttcaagatggcaacagcagagcattcaacgaacatgggaccctgtgtgattgctatgcggcacgccctgggtctgtgtgacaaaatggcttgagtcagtccctgagaagcttctccttgcctgttccataaaaaggctgatgatgactcctgtggtctaggcagagaggtaaagataagctaagcttgtgtagctactactgttattttgtttgtttgtttgtttagactgcttcttgcagagcagggctaccctaccggcagtgcgcccagagtaacctgttctttaactcaaaggctttgttaaccttaatacaatgtaaattacagagaatgtcggaaacaaaactggcagcaggtatttatgactagaggaggtgagtagggatggtgatgggaattaagagaattgttttttgttcttattggctgtggttgatgaaaacataaactaggagaaggaaataacattaacattaaatttgttccttagaactatttatttctcctagcacgtacccatttacctggctttccaggagcatattctttttttttttttttttgagatggcagagttttgctcatgtcacctaggctggagtgaagtggcacaatctcggctcactgcaacctccacctcctgggttcaagcgattgtcctgcctcagcctcccaagtagctgggattacaggtgccagccaccacgtctggctaatttttttgtatttttagtagagacagggtttcatcatgttggccaggctgatctcaaactacagacctcaggtgatccacccacctcagcctcccaaagtgcggggatcacaggcgtgagctaccacgcctggcttccaggagcatattcttaaacagtttggagggaaaatggtttgggcaaaagacttcctgttaaattgtgtgctgctttctttttcttttttaaagaactggtaatacagccgggcacggtggctcacgcctgtaatcccagcactttgggaggccaaggtgggtggatcacctgaggtcaggagttcaagaccagcctgaccaacatggcaaaaccccatctctactaaaaatacaaaattagccaggtgtggtggtgcacgcctgtaatcccagctactctggaggctgaggcagggagaatcacctgaacccagaaggtgaaggttgtagtgagccaagattgtgccattgcactccagcttgggcaacaagagtgaaactccgtctccaaaaaaaaaaaaaaaaatttggtaagacatggcttttggctttttatctccttctccacttattttttacctgtggaaaatgattcagaaaccggacagagctttgcataagaggtgtaaattgtgaagttccttaactctgaaaattgaagacataaatatatagaattttcccttctagtatcactgagggaagaatagtggctgtgggaatttggtagtttgggatattctgaaattgtttgctgtcattttcatttgtaataagtttacttggcaagttctgtaccaaagctatcttgagggcaaagtttgtgaacaccttttaaaacacagtttacgtttctagaaaaaagatcttatgcttactaaacaaaattcctttcagcagttttcaatgactcagagccctgatatttgcatagtgattcggccaatggaagttgactttgagataattttggttaagataagtctcctggtttatgcttttaaaaggttaggttaataaaggcctgtccggaatagtataatgtgcagtggtttccagccacttttgattatctcaaatgccacctatagagctgggtagtaatagtgatattaaggtattatttcagagggacccacaaggccaactttggactcttgacattaaacactgcaaaattccaaagtgcagacagcttggcaagtttgagttctggtgcattctgttcacaactatttttttttttttttcaatagtgcttttgtctttctgctaaaggtcagactgtagttgtcgagtactggtattgttcctgaattattcgggaagagggtggaaatattgacttagtttttctattataatatcctatcacaatgctggattttaatgatttaaaaatgtaaataaaagtatttgcatttttagactacttgtgagcagctgccaattctaaaatcactatgggtgtttgcagctcttttctgggctcattttacccatctttgatcttctatcaacatgcaggtctgtgtgatgggctagaaccagcatgtattttgtttagagtcagactttgttggaatcctggtgtcacaatttggaccctcggggcagcacccagattaagtaacctctgtaatatgggggtgccaccactgctttgcagagctgttagataaagtaatgcatattgcctgctacaaagtagatgttgtatttgagtgtagaggaggggtgtatttgcccattctcatgatgctaataaagatatacctgagactgggtaatttataaagcaagaggtttaacagactcacagttccacatgcggctaggaaggcctcacaatcacggcagaggatgaaggaagagcaaaagtatttcttacatggcagcgggcaagagagaacttgttcaggggaactcctctttatcaatccatcagatctcgtgagacttatttgctgtcacgagaacagcacaagaaagacccgcctccatgatccaattaccttccactgggtcgctcccacgacatgtgggaattgtggaagtgacaattcaagatgagatttgggtggggacacagccaatccatatcaagggggggtaaggtttaagtgcagagccattgagtccaggctgctgccacgtactcttccagggcaatggaggtagtctgagtctgctccatggagagtggccatgagggacccagagctgacctctgcctgcctcaagccggattacaattctgttgggactgtttttcaactgcacccagctgatctagagagagtttataattgatgtgtgtttagctctgtgtcagcatcactggtttcttaaggagtctcactcaattcattggggctaaaaacatgaaatgggtttaactttctctaggcactgcttaccactgtgccctgttaaatccccccttccagtctctgaatggtggattgggcatcttctatcattctttcatctttccaaatctcctaatgttacatccagttcatcttctgtgcctctcctactctctcttctgagctctaggccctctgggatgctggggtggagaggagaggatggaaatggggagcaagggactagtaattatttaactcgccaagcggagttggtggtgagaaagtgcctctcgtagcctgctgcttttgtgtggtttgttctgatggtggggtgtctgctcaggtgatgtgtgactctcttggggctgtgtttggctttacctcagcctcgtttgtgagcagcctgtgcaaaggacagcagtgtccccctttggtattgctgggtgttcatgccccatcaggcttcaactcctccttctagtgagtgtcctggtgcttggcccatcagctgcctggcagcccaagggctcctgcccctctgacctcaacactccttcaaaaggaactgtgtgagttactgcagtcctgtctctctgtccaggggttgtagggaactgaactggagcgggaatattccagtcttctttcctggaacattcccttgaggctctgcttgcatgtggctccctcagtgggcctgccactcccgaatctctgactcaaaaatgggtaccagtctcatgctcatgggtgtgcccccactccagggactggatgccaagttccccctactccctgacatgctccgttctgctgcagtgccagcctggaagggagcgggaaactgtgaagtcttcagctcagccagcagtcagactaggagcaagatgctcatctctccttcttgcaggtatcctagtctctcctagtgattctcttggaagtcccccaacccctacctggttggggaagcagacagtaacctgcactagaaccttgccctccccataaagccaacatcaacctttctccttgtccttgcatgggaagaggggctgtggtcaggtagtaagactggtcctctgacctcctggggaagccatagggggcagtgtctgaccctacttgtttatggctttctgagtagggtacttagccctgttgtgctcagctttggccttggctgtattctaaaaataagggaaacagcccatttaacaatatcctttttaaggatattagtaatattctctttctgtagtgcccaggatgttcttcctgtgcatcctttcctgcagtagcagagtgagggcaggaccacactaatacttactggcatttgtgtcggatttgatcagtaggcttaaaatgtatttcaccttggaaaggtatggtaggggtctccatggacatcattttaattagctgcaggaattggaggttcaaagcgccccaagttttcttcagtttccccctcctgactctatgccagtgacttagaaatataaaggtgtgttctcttggatggattgtttgacttgctgcttcctcttcatattcacctaagaaatggacggtcaaaataaatggaaagtcttactttaaatagcagagttgatgattaggttcaggtaatctatttcattgttcatttattaagtagatacaagaaagaaaaaggaaaccactgggagggtatgagtgaaatggctagctctttttgggaaaagttaatctggtggcagagtatggaaactagatcatccaggggaagaggagttggaggtatggagcactagattataggtcagtgttcagaccagaggtcaaagggcctgaccacagtaagtggcagtggtagtgggaaggaggggatgaaatgagagagaggcacagagttgctggaagccaacaacggactggaatgagaacagggaatgactttgcagcattaatctgggatccatgaaaggagagggtaccatgaacagaagtaagggagttagaagaaaagaccaatttgagggtgcggaacatcagggctacccttggcctatagtgccttttcaagaaggaaaagatgttccctcctccaggcacaggacctggcctgtagcacacaggctggtctgggctaggttctggtgcacagtgtgccacctacacaaccatacatgatggccccggggaagattcctttagagcagcaaggttcccatggagtaagaaggcctcaacacttcatcaagggcatagccagactctaatgtcgaatgagtgatagtgcttattcctgtattgattgcagaaaaagccatcatgtaagaaaagcactccttttgacagacacctacctaatctacacatatcacagcttttcttttttttatcgtgatgaaatatatataatgtaaaatttaccattctaaccatttttaaatggacaatctagtggcattaagtacatttacaacattgtgcaacatcatcattctccatttccagaaatttttatcttgcaaagctgaaactctgttcccattaaaaataattccctattccccctcctcctagccccctggtaacctctattctactttctgcctctgtgatctgcctactttagatacctcatataagtggaatcatagaatatgtgtcctttggtgcccatctgactttttaacttagtgtcatgtcttcaagtttcatcgtgtggcatttatcagaattttattccttttcgtggccaaataactttgtattgtatggatatataccacattttgtttatctattcatctgttgctgggcacgtgagttgtttccatgttttggtgatcatgactgatgctgcagttaacatggggtgcaggtatatatttgagtctttgcttctaattctttggggatattataatacctatactggatcacaaagtaattctacgtttcactttttgaggagccaccaaactgttttccacagtggctgccccatcttacattcccactaacagttcataagtgtttcaacttctcatcatcctcaccatcatttgttattttctgtttctttaaaaccagtagccatcttaataaagtaatattgcattacagttttgatgtgcatttccctggtgtcccagttctacttttatatacctgcttgtcattaagaaagctctacttttcaagaatgctggaaagagcagctttcccccgctataaactcatagccaaccttcacttatatgagaacatgcagagcatagtttcatctcctttgaaatactgtaataagagttttagatgtatttgattcaacgtgcagaatgtttattttttgtgtgcgtgtatgtgtgtatgtgtttgagacagcgacttgttctgtcacccagactagcatgaagtggtgcaatcacagctcactgaaacctcaccctcttgggctgcagcaatgctcccacctcagccctctgagtaggtgggactatgggcatgcaacaccatgccatactaattaaaaaaaaaaattgatagagatggtgtcacactgctgggcacaagcagtcctcctgccttggcctcccaaagtgttgggattacaggcatgggccactgtgcccggccactatttttcagttagttgtgagcatttaaaaaaacagaagaactcataaaaaatctgaatcttccacttttcaagaaatcccaaaggtcaggcccttgtggtccacatttccacaagtagctgtgagctagagccaagttgcttacagcccccacccagccagcttcgttccttaccggtaccggcctcacccctgcaggtatctgtttccaagcccgccctgttagagtggattttctgaggctaaagttagtttggatttattccaacttatataaataatcgaggtgattagatatgactaatacttctgttctacctagctacttaatacctccactgacactttctttcctgataaaatctgaaatctcttcatttatccttgcatcccttgagccccttgagggacaggtcttatcaacagattggtttctactggttaaaagttgcattaaatttgtctcctcatacctggaacaattggatatcatgttttgcatctgcccatcaggtagatacacccttttagctctgccacattctaacatagagtggctcttctgtcattgccacctaattgtaggcctctgcttgctagttgtatccactgtttacgttatagagaaatcttttcacatatgtaaggactttatatctgtgtgtgtgcccattcatttaatagtctttgtatatgctagaattaaggcacaagaaatacaaatgtttcatgtctgtggtcaggaaatacagttagcaatggctgtagctgtttagattgtgaagatgataattggccgcttcagatcctgtgtcttacagataatcagtactggaaggtgtagggtgaagctgcgtcacagccatgaaatggaggcattgtgaaacccaagccggcccagaacaccctcgcagcatgatttgttattgcacagagctggctgtactgctgctcaagccatatttcctgaaactcaagaacgccagagtggaatagagttctcttataaccagctcctgttccctcaaaccttcgcatgacaccccttgtggttttcagcccgtctctctgtgtggtcgctaatgacttcattaaaggtgaagcatttcagtgatcaagagccagtgcttgatgatggttggagggacgtaaatgtgcaagcgggcctcagagcctaggtggaccggcctccttgccttcactctcaggcatcacggccctccagcatgtttctctgaggagctgttgatcatttgcccaggagatggagctgggaacctcgttgtcaccaagtcagtaccaatgatttgtgcttcctgtcagggaaacctgtggtgcatgtgtttgtcttctgcttctcagccagtttctttttgcatccatcaatctcttcttatctgtcttctttttcctgactgggcatagtagtcagttgtgagtttggacttgtattttcttattttgtaacagtttgtttcctggcttcatcttgcccctccctcctaaaagctccacttgtcttttatttctcaaggtagatgggacgaggttttttgttttttgtttttgtttttgttttgtcaggttgacttacatttccccccattagggtgtgccgcagaaagaagttttctctatttctgatgtctatgtcaatacagaacaataatgaaattgttaggcaggtgaaatggtacttaactatctgtctggaaactcctaagcgcctgcaagtctttctgagtgagaatttactgtggatagcagttaagatgccccattcctgaacatgctgtaggaatgggtcctggtaggcatcactttctagccagtccaaagccacgctttcctggcagcctgttcctctcatcatcttcctgttcccatggccatggcaccccaaatgtctgctgctctgaccaaaaagctggcagacagtaaataaactgacttctaagataagaaccttcatttgaaacaatttttaacatgccttctttgtcaaggagtaaagaccctgaatcccccaggggttcctacagcccacgatggttcacaagagagtctacaatcctcagagccaagaagcactgagactcaaggacagggccacttgacagagagagcagttcccagccgacttggggcctaggaggatattctgggtggcagggctctaattgattattaacctacatataaaatcaaggacatatagccaagcacagcagcaaatgctgccaccttgtgagctgcctgtggttgtgctgggtggagatggatctagctaaggcacaccaggatgcagcttagagagaacttggtcagatttttactgcttctggtataattggaacactttacttcttaagcctactgtgtaatgttatgtgtacagagtgagtggttgcttaattaagtgctttaattttttttggtcatatatacacgtggtgcaaaatgtaaaaggcccaaaggaggggacagtgaaaattatatctttctcccacccagttccccttcccaaaggtaaacattattgccagtttcttttgtagcctagtgggaataatttctgaatagttatccatactttataggtaactctatagcgatagaactatatgtagttctatacagtatgtatgtagttatatacagtacatatatatgtctacagtatatatgtagttatatacagtatatatgtatatatgtactatatgtaaatatatacatatgtagttgtatacagtacatatatacatatctatagttttcttctatatagttatctctacatatacatacatatatacacataactatgtatataaaactatacaattgttacactgttgtgtaacatggatgtgtatacaatagcgatatgattaaatatttcttattaatgatgatttcctgcagcctttcaatcttgttaaacacaaggaaaattagaaatggaccgaacagaagtggcatcataaaaggcagctactgtttgggagcaagggacatgccgtggagaggaaatgtgtggtggtctgaaattgcaccagtttccactacaattttaaaaccatgcctagccttgccaaaggacctcgggggcaaaggttaagccgacacaccctttaggtcatggtacacagtatctctgggcacatggtggactctggtttgtgctggacccctaaaagttatttccttttatccctggttccctccctcccataggcaacattctgatatgtatacaatgtatcatttagatttgtgtgtattcttgcaatggatcttgttttgtgtgtaagtatttttaatttatgcaaatggtatggctatctcattctgttccttagttttttttactaggctttgaaagttccatccattttactaggtgtgaatccacttcattgctatctgtctttgtagggccaaactgagatttggaaaatacttgaagcaatctttgtgactttttacccaggttttttcacatgttgacacacatgacaaaaagtgcatgtacttttgtgttactgttttactcactttactatttcaactttcctccattttgctaatttgtcataaatattaatggctgtatagtattccatttatataatcagttattacttcacactctctcctgtcatcagacatctgagttttttatttttaatatcattgtggttacatgcgtatcattggtctttgttgattttctttttcttaagccagaacagatgcccaatagggaattattgagccagagaaaaattctcctatagcatgtgatggaagtggccacattttacctcttgctttatttccagaaatgaacacaggtgtctatatccatttaatacacccctttttggccgggtgtgttggctcacacctgtaatcccagcactttgggaggccgaggtgggcagatcacttgaggtcgggagttcaaaaccagcctagccaacgtggtgaaaccccatctctactaaaaatacaaaaattggtcaggtgtggtggcgtgtgcctgtaatctcagctattccggaggctgaggcaggagaatcctcgaacctgggaggcagaggttgcagtgagctgagatcatgccacagcactccagcctgagggacagagtgggactccatttcaaaaaaacaaaacaatacaccactttttatttgtagtgcactatacttagagctgttgccataggaattgatataccaggcgtcatggtggtcagcagacaaataggaaactcctgttatgtcgtcagaatgagttgcagagagtaccatctgctacctgtattgtacatctttctgttcctctgtcacgcctggcacaagagcagcattggtttaatcatcagcagcccttctgctctctgtagtcaggattggcagtaactcattggtgggcaacactgccttggtcttgccgcttgcactgtgaactgtaactacggacacacatgtcaggaaagaatggtgcttgggatgctcctcctatctgtgcctcaaacgttttcactcgagggatattaaaaagtggcctactgcttataaagactgtgtgtcagtgaagaggaagaggtgggagtggagagtgggaggcatttgcaagaacatatgttggattctttttttctcttcttggtgacaatgattgacggcatctagtgagtccctgtttgtcacttccttggtacagctggtagtggaggtgggggaaatcaataagggctggacaaaggacatagctagaggaagaaagcactgcaaatatggtattaagatgacattcctcacagttgaatttttcactgtgctattacttcacactacctgctgcgagctattctcttttgatcctttaggctgtagaggaatcagtctgtgtaactctccctcattcaccacctccaagaaagggttaactttggacataagataactgtagtttaaggggaggaagagaaggaaggaaattcatactggatacagcttttgccagttttgtttcttctatgttgaaatatgggctggctttatggcattctcttggtgttctggaatgtccattatttaacaattccatattgaatacttgcttggggcttagaagagggaagtcaagtgtaggaaggagttgtggcaatttaagtaagtttacaatgatcttattaagcttgttgctttcattttcctgcctacgttggggcaaagacgtgttaaaagtgcaagaacagtgattattttgtggttagagcatgtgcacagtgtagacaaacccaggaaggagaatctgcttcatcaagtcttaagttgttatttagaccaaaatgtatgcgtaagcctcagatgactgttgatgtgccaggaaacttctgctgagtactttcggttctttcttctttactttacctctgcaccccagctcatggttatcttgtaaaactgaaggtgctttgcactgcaaacagacatgacagctcagtctcccctgtagcaagttctagggaaggcaggttggcagagtcccatttttgagctcagttctccaaggccctttggtcagcttattttcctgcagggtgtcacatcccacagtagtctccacctggaagacattggatctcatatgttcagatcagtgtagccacgctgctctgtggagaacagtgtgataaatccttggtagcattacgctttaaactggtggccacttgcctacctccttttaatttcattttgttaacaattgtttcttgaggacctgttgcatgctgggtgcttttttcctgggtgatttcacatttagcatctgttttcattctcatgacttctctgtgaggtagcaagtattgtacccagttttctgatagaggaaattgtggcccagagagattgttgtaccccaaagtaatgaagatgaatacagttgcagaaccaagttagaagccagatttttggagatccaaggtccagtgaacacagctgtacccccacagacacttccgaaagtgaccacagcctcttcagccagtcctgaagagtatgttcaccttcatctgtcttaaagcacaggcacacctggctttgggaaagcatagtttatcaagatctgaattggctcattttagttttagaaaaggtttcacctaaggcttctgcttaagaagagagcattcctaggaagtgagcttaagccctgttcaccctattaatcttaagtgatttgtcagagcagagtggcagagaggtgtcctgcagaggtgacaacctgaatttaaatcacagctcagccgcttactagctgtgtaatcttgagcaaattacttaactctctgagcctcttcttccttctctattaaaggggagtgatatcaatctcatcagattagtgtgagaatacattcatataagtgccaagtacctgctaagtgctagtccatgtgctaagtaaatgtgagctgcaattgtttgccattggcattatcagtagagtgggagtctcattatagcagaaacctggctctcctgaacatatgtaaatatttacatagcccctactaaatgccatttaagagtgtatctagtgtaaggcaataggatgtgtttagcaggaggagtggatttgttcagggggtgcaacagactgggatgggagaagaaggcatgtttgatagtcaaaatgctggcatacttcctgcgcaaggaagtctgtatggctaaacagtgctgaactaaacaaatactgctgaaggtcaggtgtgaacagtgaatcatattggcggggcatggtctgggatatggtggtgagcagtaaaaactacaatagctaccatgaaaggtacctactatatgccaggcactgttctagtgcttttctcctattagcccttggaagcagttctattattatcccattttgtagattaggaaacagactcagattaattcagttacccaaggggcacgtaactggtaagtggcagagctttggttcagtctcaggcgtcgagctctggagtgtgtgtgtgtgtgtgtgtgtgtgtgctttcaaccattgtgttagatgcctctcaagacagataaggtccttgctattgtagaattcacagtctaactgagtgagccagtcaaactaataagtattatatctagtctgccaggtagtaataaatgcagtgaagagaaaattgggtgaggaattttagaggatgatgggagttgatgttttagctagtgtattagtttgttcaggctgccataaacaaaataccacagattgggaggcttaaacaacagaaatttactttctcacagttttggaggctggaaatccaagagcaaggtgtcaatgtgtttggtttcttctgaggcctctgtcctcggctttgcagatggccctttcactatgtccttctgtcttccctctatgagcgttcagccctgggagctctctgtgccctgatcaccttttcttataaggacagtagccacacctaatcacctcattttaacttaaccatctctttaaaggccctgtcttcaaatacagtctcattttgaggtattaggggttaggacttcaacatataaatttggggaggggaacacagttctgaccataacactctgccctctgcacccccaaaattcatgtcctcctcacagcaaaatacattcacctgcattcaacaacctaagccttaacccattctagcatcaattctaagtcccaaatctcatctaaatatcatctacatcaaagtgagagagactcaagtatatgattcatcttgaggcaaaaattcttctccagctgtgaacccgtgaaaccagacaagttatttgcttccaaaatacaatgatggggacaggcttaggatagacatttccattccaaaagggaaaacttggaaggaagaaaaaagggtcatgggtccaaagcaagtccaaaacctagctgggcaaattatgttcaattttaaggcctgaaaataattctttttacatgatgatctgtcctccaggcccattgggctggcagaattttttttttttttttttcagtatttattgatcattcttgggtgtttctcggagtgggggatttggcagggtcataggacaatagtggagggaaggtcagcagataaacatgtgaacaagggtctctggttttcctaggcagaggaccctgctgccttccgcagtgtttgtgtccctgggtacttgagattagggagtggtgatgactcttaaggagcatgctgccttcaagcatctgtttaacaaagcacatcttgcaccgcccttaatccgtttaactctgagtggacacagcacatgtttcagagagcacggggttgggggtagggtcaccgatcaacaggatcacaaggcagaagaatttttcttagtacagaacaaaatggagtctcccatgtctacttctttctacacagacacagtaacaatctgatctctctttcttttccccacatttcccccttttctatttgacaaaaccgccatcgtcatcatggcccgttctcaatgagctgttgggtacacctcctagacggggtggcggccgggcagaggggctcctcacttcccacacggggcggccaggcagaggcgcccctcacctccctcccggatggggcgactggccgggcgggggctgccccccacctccctcccggacgggggtggctggccgggcagagaggctcctcacttcccggacggggtggctgccgggcggaggggctcctcacttcccagacggggcggctgcggggcggaggggctcctcacttctcagatggggcggccgggcagagacgctcctcacctcccagacggggtggcggtcgggcagagacgctcctcacctcccagacggggtcggggccgggcagaggcaatcctcacatccctcacatcccagacggggcggcggggcagaggcgctccccacatctcagatgatgggcggccgggcagagatgctcctcacttcctagatgggatggcagctgggaagaggcactcctcacttcccagactgggcggccgggcagaggggctcctcacatcccagatgatgggcggccaggcagagacactcctcacttcccagacagggtggcggccgggcagaggctgcaatctcggcactttgggaggccaaggcaggcggctgggaggtggaggttgtagcgagccgagatcacgtcactgcactccagcctgggcaacattgagcactgagtgagcgagactccgtctgcaatcccggcacctcgggaggccgaggcaggcagatcactcgcggtccagagctggagaccagcccagccaacacggcgaaaccccgtctccaccaaaaaatgcaaaaaccagtcaggcgtggctgcgcgtgcctgcaatcccaggcactctgcaggctgaggcaggagaatcaggcagggaggttgcagtgagccgagatggcggcagtacagtccagcctccgctgggcatcagagggagaccttgcaaagagggagacgggagagggagacggagagggggagggggaggggagggggaggggagggggagggagaggactggcagaatttcttcaaggccccaggtggcagccttgcttttgaggccttggacaatgacagcctcaccctctcacactgagacagagagagcctcaccctttgaaatggaagagagccttcctcgcccctgggcctgaacactttcgttgtggggtgagagtagtagctttagggaccattcttcctttttcttgaaggataatacatgctcacacccagagccagatagatctattgtcccatcctgtagcatctcagaagcctgctgctgttgtgtcctgtctctgtcccctttagtccaagtcagcagtgtttctgctactggtagaaccccgtctctattcctggcttctgttgagatggccaattagatctgtgagtcccactgtcactctttagggagtgattgtccagtcacactgttggtgccctctccagaacacattctcatttttttgcaatatggataagctgagaattttccagatctttaagttctggtttgtttagcctaacaattttttctttaatttctctcacttctcttgcactttaatagaagcagtaaggagaaaggaaagtggcaaggaaagcacaacaggctttcaacacttggcttagaaatctcagcagaatatccaaggttgtcacttacaagctctaccttccacaaaacacaaaaatgcaattcagcaatgttcttggccattttataacaaggattgccttttttcagtgtctaataacatgttcctcatttctgtctaaaatctcactagaatcacctttcatgtccatatttctagcaacagtctctcttagcatctgagacaacgttctgtggaacacagtttggggaagcttgccaaactcaacagattatactatatcatctccccctgaaagagaagagtgagacataagtcctctgcagtctgttccactcctactagatcttgaagtcatatgttgattcttttcatggtattgtgtgcctgtgttttaaggaaaataattagcattcttaaagcaaagcaaaaattttactaaagaaaataattagcctttcatgtcactttcttagagtgaaccaaataagttttgtatgagagaaagataggggcccgtagatgcccactttagttttgcagggtgggttcctacagccacgttcccctgggctaataaggctaatggaatcatggtggcagttttgcattggcctccagctaatgaaaagttttgccatgagaacttaacttagtccttctgatgcttttactgcctgttgacacagaaggtggaaaatgaccaactatgctatacataaaaacaaagtccagatattcttatattcttttagaatatgtcttatgtgctgatttttaaaatattaagggaaaaattgacttgtgatacttgaaagttcatagaacagggcactgcattaaaacagggcttatgcaaataaaacacatttttctgttcttggccagcagttctaccgtcaggatacttattccatacagcactgtatgatacagaccaagatttatagttggtgatttcctgagtaacaactcagatagcaaatgcctccacaaaacaactttcgtatgttctgcaaggcacaaagtagtacaatagaaaggattgtttgcttcaggatttttgtggggtggtttctttttctttttcttttttctcccacaagacagaatttttcttcttgccctaaaatttgaaagatttctcctttctctccccttctgccacaagtagtcccaccctaaaaaggaagatgaggttctctagcaacccataagatgctcataagaaatagcttaaacttttgctttgaaacaagacattcacatattggggttgtgggccaataaactagtcaatagaaagaatggggaagaagcagtgaatgcaaggacagtgttggtggggaagggggaatattctggttttcgtttctgtggatttttaggccaaatttgaacacaggctcttgatgacacatgaagtatctctaacttgattttatgtatgcacactttatgtactatctgtacataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacagaaagtagttcaaaatggatcaaagacctaaactatgagataaaagagaagaaaacataggtataaatatataacatataaaataccaaaaatataaacaacaaaagaagaaatagataaatgagacttcatcaagataaaaacatttttgcttcagataacaccattaagaaagtgaaaagacggctcacagaatggaggaaacactttcaaatcatataccaaataagaatcttgtatactgaatatgtaaggaactcttataactcaaaagtaaaaagacaaataattcaactaaaacatgagcaatagatttgaaagacatttctccaaaagtatataaatgggctatatgcatataaaaagaagctgaatatcattagccatcagggaaatgaaaatcaaaaccataatgagatgccactttgcatccactaggatggctgtaatcaaaaagacagaagaatattggtaaggatgtgaagaaattgaaatcctcatacactgctggtgagaatgggaagtggtacagctgttttggaaaacagtctggaagtcctaaaaagatgaaacatagagttaccatatgacccagcaattctactcttgggtatatacccaagggaaatgagaacatacatcagtgcaaaaactagttcacaagtgtttacagcagtatcattcacaatagtcaaaaagttatgggggaaaataacatgtccaaaaactgatgaataaataaataaatgtgatatatccatacaatgaaacattattcaagaaaaagatatgaagtccagatacatcttacaacatagatgaaccttgaaaacatgctaagtgaaaggtcacaaaaggccacatattgtatgagtctatttatatttacatgaaatgttcagaataggcaaatctaaagacagtagattagtgtgttaggggcttgggggtaaatggagaatgactgtttatggatataaggtttctttttcggtgtaaggaagatgttctaaaattgataatgatgatggtctttcaaccctgtgaatatactacaaaccattgcattatacgtgttaagtgttgagtgtatgatgtgtggattatatctcaataaagatgttaaaccacacacagtcatattacataattacacagtcatattgaattccgttataatttcagatttatggactaacactgaatactcagagtattaagcgacctgttccagtgcatatagctggtgatcacagagccagacttcctgaacatcaggccaactgtctctccattgtgattgttacaggaagtttgaccccaacataccatacaagtcacacttaaaatttgtattggtgtggccaggtaccactcacttgttcatgtaacagatcagcaagcccctgaaaccgaggctggcaatagcagtttaattcctgctcctgtaaggttcagtagtgtaggctgggggtgaggagacacaacagctgctgctgcttttcttttttttaaccaacaagaatgaccttgaaaacatggggttctttaccacacaattattcagggaccctgtctgatggaagttcttctaccttctccagccagcagatggggaggagagagaggaggtttatccatgggaggttttcctgagccacacttaggggtggtgcacctctcacactcatttccccacaccttctgtggttacaacccagtcacttggcaccttacagatgctgtggggctacgaatgcagactctggtattgaaggagctacattgtctggggtatataccctggggtttgttgtcgcctgccaggaaaatttaggacacatacacaaggagtttaggagcagaaggttaataggtagaagagaagagagagaaacagcttcctctgtaaaggagggggtctcccagcagaaaggacctgctggtggtgaatgcctcgagtgttatagtagggtttcaagaggcagtgtctgatttacctagagctcatagattggttcaatcaggtatgacatttacatagtgcggggaaggctggtttccccaccctaatcttcttatgcaaatgggctgtccagttagggccatcttgtctgctcctttacagtacaggtggctggcagagaagggaagatggagccgccatcttgaacatgtctactccttagttcccgctggcattcacctgtgcaagctcccagcttgctggctgctctttgatagaaaatgatttggggctgcttttcattaaaaagaagaaccttaccaaggactcccatacccttgctatctgcctgcgtgatttcttcttaactcctatatccctatctgggcttgaagttttctccttatacttaaaaaatcaatccaaaggctagtcagcccgcatgatgactgggcacaagtttagaagtttcatatcatggctcctgcttcattgtgagggattttaatacctttagagcaatgttaagtacccagtctgactggttattctgtcagcagagtctgtcacctgtcctagaagaatagtcttgtttgttgctcctagactggctgatgattgataggagtttccaagttgtatcttattggaaggacctttgagagctctaggcctgtgggccttcctgaggaggtgactgcatttgaataggctctaagtttcctatatcttgcctctgccctgctacagcactacaaggggaaacctggaccatttaccctgcctgttgcaaggtaggtgacaaagaggaagttctgagagaacaaatgaagccccaggaatctactcaaccctgacagtgaatatactatcttctgacctcatactgaaacagtgacaacatctatgtctccaagccgtggaactctaccgctactctggaagcagccctgcagtgttttgttatcacttttgttttacactaggctagaggattcagtttggtgagttgtgagaaattaaaagttggaattagaggagcagaggctggcccctgtcagcttattgagctgggtagccttagccttttctgagctttggaaaacctcagatatcatgtcagaaaatcaacagaatctgagaaaaacaccggaaaatcatcagcaaatggtgattctgatagcatctcttccttatggggtcatcatgagaagattccatgataatccccataaagtatcaagtccagattttggcaaaagatcatgctcaataaacactagttgtcattgataataatagcatcatcttttgactttcaaggcagagaaaaagaggtatctccattgatgcctaatgttaaaaaaagtaacattttgtaaatctttggcaatatcttaaaatattttatgatgtaactgtgatgcttggaaaactttctttttagcagtcagaatctttcataaccatatgttaagtacttgctttgtgtaaacaggttgccaggcacaaagggattataaagagaaagaagaaatggcctttgcctttgagcagttcataatgtcataagaattagccatggctatattttaaataggttgtagctaacctaagtttttgctatcagtgttttatttatttatttatttttaattttttttgagacagagtctcactctgtcgcccaggctggagtggagtggtgcgatcttggctcactgcaacctccgcctctcagattcaagcgattctcctgcctcagcctcctgagtagctgggactgcaggtgcccattacgatgcctggctaatttttgtctttagtagagatggggtttcaccatgttggccagggtggtcttcaactcctgacctcaagtgatccgcctgcctgcgcctcccaaagcgttgggattacaggcatgagccaccatgcccggcctggtatcagtgttttaaacctactgcacatatatcctaatatagacaaaaatgtgattacctctttttaaaaacaagcccaactctaaaatatcatacttcggggagcttttatttttgcctcctgccccttgctcccaattgtcaacttatctccccctactcttgctaccaattgtcagtttacccccagcccctacccctcacacatataccccaatttccaggttgttataaagcattcatatatttttgtgtaaaaaatgatttcttgcatttttccaagataattatttgaaaatgtaattatttgaaaacagattgtgttttaatgtgaaatcacctaataccctaattagtttatttagcttagaaacttggtctagagcagtggctcttaacttggccatattttttttaaggcggcattactattgatttcttctttacaaaatttagcaagtccatggtattcttacttcagtttatttgacacaaggcccacatgagatgtgaatgatatgcatgatatgtgaaaaggaagttcatcatcatcacatcttacctgttccttgttcttccagtttcacagccgttagaatgttagagctggcaaggactttatcaccaaattcttatcaccaacacccctcctttagcagaggagagaaactgaagctcagagaggtgagggtacttgcttgcagtcacaccaccactatgtggctgactcctggtgcagaaccctcccttcaacccagtgcctctccctggctggtaatctcttgtctgtttttctttttttttttctttttgagacggagtctcgctctgtcgcccaggctggagtgcagtggcgcgatctcggctcactgcaagctccacctcctgggttcacaccattctcctgcctcagcctcccgagtagctgggactacaggcgcccgccaccacgaccggctaatttttttgtatttttattagagacggggtttcaccgtgttagccaggatgatctctatctcctgacctcgtgatccgcccgcctcagcctcccaaagtgatgggattacaggcgtgagccaccgcacctggccctctgtttttcaactcccttttctgagctgtcaccaagtcctcttactgtttcctggaactgtctttcggttgtcttccttcccgtttcttcctggctgatcccgtccctcaacatctcacaatgggaaaggcctgacagaggagtcggtctctgaggcgtccattataccatattaattttctctaattaccactgtcagcacattactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtcatttcctcataatgttgatgaagaaaaagaaggggccactgtggagttcgtgtggtctccccaggtctgcgtgggttttctctggggactcgttttcttccacgtcccaaagatgtgcatgttaggttaactgatgtggctacatagtccccactgagtgtggtgggggtttgagtgtatcctccaatgggaacgcatcttgtccagggttggtgcccacccccctacctctgagctgctgggataggttccggccacccaagaccctgacctggaataagagggtgaagaattttcttactttttttgtttttccagtcccttcattatactaaaagtttatgttaatctttcttaattgtatgtatagctcacatttatttcagtgtttaacatagaagtgttttggtctttatttagaagtttgttgatgtttttgtgaccagaaatatgcaataggaacttaattattttttagagacagagtcttgcactgttgcccaggctgtaatgctgtggcctgactacagcttactgcagcctcaaactccagggctcaagcaatccccctacctcaaccccctgagtaactgggaccacaggtgcaaaccaccatgcctggctctttttttttttttttttttaagagagccagggcctcactgtgctgcccagcctggttcaaactcctggtctcaagcaatcctcccacctcaccctcccaaagtgctggaattacaggcatgagccatagcgcccagtgtaacttgtttatagaaattagcctatggtaaaattgattttgttatacattattttgcttaaattcatagttcccaagtaggtgaggacttactgtactccattcttcaaggccaagtccaggttctaccacctttttaatgttttccttgattgctgcagtgataacccaattattcccctttactcccaaactttttctgattatatcctaccatgtagcattgcacatcatagcctctcatatggttctctggcttttccttagaattgtgttgccttcttaattatatttaatgctctttgaaggcaaggcttatgtttatatttttatcatatatactattcccctcccatccgttggaaatatgttcaaagaccctcagtcgatgcctgagactgaagatagcaccaaaccttgaatagactgtttttgcatatagatacatacctatgctcaggtttaatttataaactaggaatagaaagagattaacaacagtaactaataataaaacagaacaattataacaatatactatgataaaagttctgtgaatgtggactctgcctctgtctcaaaatatcttattgtactgcacttacccttcttgtgatgaggaagggatgggagtgggatagcatgagatttcatcacactactcagaacgatatgcaattaaaaactcatgaattttgtattcctggaactttccatttaatattttcagactagttgacctcaagtaactaaaactgcagaaagtgaaaccttggataaggggggtctactggattccaattttatagtgcctaataaatggtcagtaataaccacttattaggggcttgttgaacttctacaagttgttgttcagagctacaagcagttcagacatattacagtgttggcaacttgggttgggatcagttgttaatattggggcacggtgctctactgtttaagtgttggcaggatcagtggctactgtgttaatgatcctctagggagactgtctatatagatatggtgctcacgctaatagttggatttgtagatcagtagctgggtggcagggaggctgggggctccctgctgagaactgcacaccgggttcttgaatcttgcagtaggtaatagttacttgagaaaggagtatcctcatgactctggcagatcctcagcacaccattgtgacatgtgaactggcctgtctcctctcccactgtaagtccttgagccagtaatgaccttggtgttctcttttctacaatactggcacaacatcttaaggtttaatctgatctttgtctaaaatatttttttcagaacccattaagtacggtgtcttcccaaaaaagataagtgtgttgtcataagttcctggtattggaaaaaggagtctgtgttatttaaagaagccttgtctgcttccttaattccaatgccccttttccatgccttcctacctttcctggtagtcattcctggactgaggtaactgcagattttatagtacttgggactatgcactccctaaggcacagaccgtataagaattgcctctgccaagggctcctaaacttggaattattttttctttaatgtcagcaggactaattccacctatacaaaatggtttggccttttccttctttggcacaaaagagacttggcagaggctcagataaaggtgaagttgacgagctctggcatgggagtgagctcagcgcttctgggctttcattccccctgttcgtctcatgttcaaaatccccattccacccagaaagtcttcccttcccaccagtgacaccgaaagatgtttcagatccttcttcctttgtctccaacacacacagcgaaatgctgcatgccttcatttgcagaaagttacccaactggaatcactttaatattttttttttaatctctttaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataaggtaaccaagatctaattggttttggcttccagctaaaagtgaaagtttggtatttcatatcctctcccttcttttactcttagtgtttctgtaaggatttggggggctgggggatgtctttggagcctgttaatagcattcctgaggcagcagcagttttaaaaagcaaagtgtttctatttctggtctgacactaagagacctctgacttatggggcttcccaatgcctcccccaattattccttcagggaagtcactcttgactttattagtgccagtaaaggtaaaagtgggggcatgctaccactccttttttcacttgaacttgtggccctaaagagttagggccaatgtgataaaacaagtaggaaggtcgaatgatcagccaagaattcttttccatttcatgtttaaagcaagatacgactaaccactttgtgtacaactagttttaagaattgtttcagggctaatttgggaagcattagaaaataaaaagctattgtagcccttttagaaacatcacaacagctgagtgtggtagctcttgcccataatcccaacacttttggaggccaaggtaggaggattgcttgagcccaggagttcaaggctgcagtgagctatgatcacaccactgccctccagcctgggtgacagagtgagaccctgtctctaagataataatagcaagaagaagaaagatcaacaataaaaaccgcactgttatttaaatttagaaggaggagggagaagaaaacaaaattaaaataaacatcaattttatagtaataaaaatcccgattttttagagatacatatcaaagtatttacagatgaagtgatagatctaggatttgtttcaaaataattgaggggaaggtagacagatgataaaaagctggccatgagttcataactgttgagttgaatgatgggtacataggagttcattatactattctgtctacttttttacatttgaaattatatattcagaaggaaaaggaaaaagcaaacgccaacctaaaaggctcctccattagcaatgtatcttcaaaacagattttttaaatgtctggtgttctattctgcaatatgtgacctcttgtctgctgcaggtcaaggtttctaaagcttctttgaaacttgatctttatttttttaatgcattcagttctttatatcaatattttttatctgcagattttccagtattctgaacagttatttctcttacagctgtagggaatatgttgcatatagttggaaaaggaatgatttcccatttattgcatgattcatagtacccttcacttctttaggcaaaatatattctttaaatatgtatattaaatacagatagaatgtttgaataatcttcaaggttaacagtagacaagattacttgtcaaatttattttgagtctgtttttctagtctggtcaaaaaggtcactgagcaaaagtttttgccttgaataatgttataaataaaaatgtttacatttattaaagtaaatttgtgttcatgaagtttcactccagagttccagctcattataatcttccacaagactttaataaaacaatcatttagccggctaaaattgaagtttagaaaaattttttgagaaatgtttttagaaattcagagaagcccagaaaaagaccatctgtatcctctctccacaaaataaatattagtccacattttagactacagcttgtctttttttcattgcttttattttggttataatcaagatctaggtctgtcagtaccaacacgtatgtagatttgatgatagagttaaagcgtagttggggtaggctccagctccactgaaagggaattacagattttcttttggctttcatgaactgtgagaatcaggctgggaagacgggcccttcatggaagtgagcctcagagcagtatgtgtgctagttcttttctcttcctggaatgttgtataccttgaatataggagtgtccttcctgaccagctcagggccctcatggcagttgcctcatggcaacttaaacaggtaccttctcctcctggcatcagatatcctattatttaaatgaatagcaacttctctttaggatggggacaggggaaataatattcgcaatttctggttatggaataaaatacttgcggggcgtaggcaggtgatgacatacatccccaagtgaaacatcacaagagggaggccacccctgccccatcagatccctggaaggccgggtggcacagaggtgatgctgggagaggagcaggaaggagggaggtgcagcaggagggagatcgtggccagctgtggcgtgggagcccatccttgctgagctaaaagaaaaaaacataagacaaatggaaaggacccctctgtggattgactacagaaaagaggtttgtttttttctttattaaatccctgaaagtgcctagtgttcttgatggaaactttgagtgatttgccatgtaatcataaaatcttattttagcgccttttcatctctcatacgaaaatgaaaggagataaatattagcaaatagataatgcaacttcctgatcttgtgttcttcaggactgaagcatgtcacatagccctttgcaaggagagctaaatcatgggactaaggcaaagatgttgaagcacgagggaacgctcaataacccagccccagcccctcgtgccatctggaaaccatgaattcagtgaactcgggctctcgctgcagggtctgcctagactgcagccataaaatatgtcagccttggcactggcagctttgatggccatcagttaggcagacaggagcttttgtgctacccccttctctttgtcagcttatgtacaaccctagttcctcattaatttagggttggaaagatgtcctgagtattagagttcaactttccagttataagtattttttccatggccacctccgccctccacaccaggtctgagttacatgcccacgccatgtgcactgcagctcctgacacagtctctcttgcacatgccatagtgtattgtaaagtgggcaggcaccgtatgtgcctctatgccccatccccagcaaatggggcagggtcttatccacagtaggaacttggggaatagctgttggatgaaggaatgaatgacaatagtttcacataagccaaaggattccattccttttcttaccttctgtgctttatttggtacatactcagtatgctgagtgtgatactcttcctctaagaacggtgctcaagcctcctgcagaaccacctaatgggtgtgtgtaaaaattggattcctgggtcccaccccagactactgagtcaggcagcatctcttgacccaggaagcggtactcttaataaatcacctgcaggtgattcttttcttctgcactttgagttgagaaccactgctctaacaggtgaataaacattaatataacaaattgcaatacagttgtagggaaggaagataaaggtatgccacgatagaaatacatatagggtagaattcattcatccatgcaacacttatgaagacccattgcatgtcaggcactattctaggcactaatggcagaatagtgagccaagcagacaagggcctggtttcatggtggcggggaggcagactaagtgaatttatagctgtgaattgtgataagtgtctgaaggaagacacgaaagccagtgttatgggtagatagcaacggccaggagatgggcttctcagaggaggagtttactctgaggatggaagagtgagaagaaagtcacctgtgtgcagtcaagggtgggcactgggaagaactgtccaaagagagggagctcatttgtgagagacttgccacaaggaggaaaagagcttgtccgtagcagagtggttgaaagggacagtggtggaagatgaggccaggaagagcagagatgagattgcacagccatgcaggccccatggagcacctgagatttcatgctatgttgaggggacagcaatcagaagccttgtgatgccatatggtgcagtttgcgcttcagaaacatcagttgctgctatacagagaacaaaccagaaggaggataagaggggagacagagtccagtgaggggataactcagtccaggtggcagtgacctgcacagacaagaagtgaactgcttcaagagggaaaaccaagggtggatcctgaaaaggaaatagaaatggatggagggccatgagaagacagctgggtggacagtgggagatgaccaaggaggagggagcagtcccgtccattctaaatggggtgtttggtggtgaagggccaggaaggtttccatggtggggacttgagagattagagagtggtcccaagcagactggggcaggcaggagaaagaggaatggacagaagggccttccttggagaggtttcagtctgacaaggttcaaagatgaatagtactctgaacagcaccttgataattgtaggtttataataaattcttgtcaaataggtaggtgtgccttagatagggaaggcatgcacacagtggttagcagtgtgaactgtagaatcaaaatacttcagcgtctagcttcgccattaactttggctctctgagcctcagtttcctcacctgtgaagtgggaatacagattgaatatccctaatccaaaaatccaaggtgttccaaaattcaaaactttttgaagaccgacatgacactcaaaggaaatgttccttggagcatttcggatttcggattttgggattagggatgcttagtcagtatgtctgatgcaaatattccagaatttgtaaaaatcagaaactcgaaacgcttctaatgccaaacatttcagataacagatcctcaatgtaataacaacagtatctgcctttgtggagatattgtgaggcacaaaatgatccatgcagggcacttggcatggtgcctgacagacatgagcatctagtgaatattggaggcagtgcttgttctaaggtacttgagcagtaaaatgagtataatatttggacttgaagtccaaatattatgggattctgcaagggagtcttaaccttgagcctaacaagttaggtcaactcaagcatcttacttatttgtgccatcagtttcctcatctgtaaaataagcaaatttggataatgttatttgtttctaaactacctcctggttttaaaatgctctaattccaatatgtagaatgttagcatccaatgatgacaatgtaattcctcatctatgcagtttaaactagatgaaccatgtttgctggtgtaatagctcagcagtggaaaaacagcatatacttcctggtctaatacctgaaagaaattaggtgtatggataacagcaacccttggctaaatctgactgtagacatgtcacctcatctaatagtaatatacaggactggagcgggaagaaaagacttgttaaagatgattatagtggactgggattatttcaagcctaattagaagaccattttcattctaagtgaagcaaactcagtatgttgacaatgttattgctgcaattcactaacgaaagtgtgctaacatgaatcacaggattctgaagtcagcattctcaggtagtttaaaaggatgaaggatttgaaatctgtcatttcatttgttgcagaaatatgaccaagataaccacccttttcttcagtgcctcttaacatgaagcactgaaattttttctgaccttaaaggtaaacgaaagttccaagcctaatcttgtattgtaataattataatagctaatatttactgcattcttaggtgcactttgcaactaaataccttccatatattctcagattaatctctgcaactcaaagaagcattttgtggctcaggaaccaaggttcagagagatttctatctttcctgagattactttgctaacaagaccactaaacacatgggtgtctttgttacataatttgggattgttggagcccaccagttttggacaccagaagccctctgtggtcaaacaagattaggtttatttaacttgttgggcaagaaaagtgcatacccatattgccacagtgaagagaaatgagtagatttgggcttgtgctgggtggttctagtagggatttagggaagcaagaacccattttcttttgggtgtcatcagaaagtgggatcaatttggtgtcttggtaatttttatctaagaggtgggaagattgaatagggacttagattgtcatcagtaaagaaagcagagtacctcatattagttggaagagggggacattatttattttgtggcacagagggttctcatacctgtcttggttcagacttgattgtggattgtttctatcttgttcttccatggtcacagagtggccttgtctgaaaattatttgcataagcaaatttttgctgagttataaacactcaaacagtatagcctgacctgtcaactctctgggctctgtttattccttttccttcttcccttccttcaactctcccttcctctatctagttcattagtagttaatttttgccttccaaagaataatcaaacaatctaggtccttcattcttctctgatagagtgttagcatagggaaggttttcagatccggagagatgtagtcttgaatcctaggtcagtcagttgacaactacttgactttaggcaaatcacatcatctttttggtctatctttccatatctttaaaaaatagaaatttattccattgtgtgaatgcaccagagtttatttaatcttattcacccactaaaggacatttccattattcccagtttgagtctattaaaataaagctgttatgaacactgcaaaaaaaaaaataggaatgataattacctttcagggtgttttgaaaattagggttaatttacatgaagtgattggaacacatggttcaatcacgaatagtggccaccattgagaaggcataaacatttgtcaaatgttaatttgcttatactttatatttctaacagcaatgaaaatactttttatacaacaaattattagattgtagaaggtaacagaaggtggggagagccaaactttctgaatgtgattatctactactgaatgttagttatatggtaaaacttgctatagttattgttttgtacatttattaaaaattacaataaatagataacatggtgctatgcatttaattagtgaaaagcacaagatcattttaaagttcttaatggttcattcctgataaatttttatgagatacaggcaagaatgctatacttacaggctgtgcagaaggaatgactatctgatgagggctataaagaagaaatggaagatacacaaaagctatttttattgtaggggtagaaaaagatcttgttaaatatttctgctgaaggtttgtttcttatatacaaggccaagatcagggttaaattagaagaatcaatactaaagttagttctgaattgtgggatggtttttgttttcatctttgtattttgctatattttcctattttccaggttttctgcagaaatattctattcatgattagaacaaaaaaaaatgtagtcttctaaaaatcctgtctttttctgaagttgctaggcctctcagccatggttgccaaaatctggacaccatgcatgtgtgtgtatgtgcgtacacacccacgcctgtgtacatgtgtctcataaaacatccttaagcatgagctagacattaaacagtcttggagattctagttcagaatttacctcaaacgtgtgaattatggaaattcatggttcatcacagatggttgggatgttgccaagatacatcctttagcacgcctctgtttgctttatgtgaacattaataactctgttccaggagaaatacaattgaaaagcatcctgtacatgaaaaaagttattgcaaatgactcactttttgtgtggttccttctctccctttttccctcctatcgtcactttagaagtctggccttcattttcgacacacagataataccgtccagtggttaagagcgatggagtctattggtctacccaaggtaagccttcacgcactggaatctgaactagaaaggcaaaggggtagtacacaaacatctctttatgagcaatgactttggagactgggttatgttaatgtagaaatgagaaatgtgaggactaaaaaacatggaaagacctatccaaagtaacatatggcaagaactcagaatgagggatgtgcccagattgagagcagccaggtaaaattgtgcacaaaataaaggcagaacaagctatagctggtagataggtgagctatctaaaatagccaactccctttcttgtgttgctatttgtacataaagattctaagtctcagccacttttggtggctcatgcctataatcccagcactttgggaggctaaggtgagagaatcacttgaggccaggagtttgagaccagcctgggcaacatggcaagaccctgtctctattaaaaaaaaaaaaaaaaagaaatctcattgtattagtatacactttattactgtaaattattataaatttattttttgtaaattattgttattattatttcaagacagagtctggctctgtcgcccagtctggagtacagtggcttaatctaccacctccgcctcccatgttcaagtgattctcctatctctgcctcccaagtagctgggaacacaggcaagtagctgccccatgcccagctaatttttgtttttgtttttgtttttgtagagacagggttttgcctcgtcggccaggctggtctcagtctcctgagcccaagcaatctgtccaccacggcatcccaaaagtgctgggattacagggatgagctaccatgcccggcgtataaattatcattataaatcataatatcacttgtaaaggctagtgggttatagctcttactcctaaaatagatctcctaaatataatttaactcagcaaacattcagtgcttgttaaatttgaagagcaggcatcctaaagtctgtgagagaattaggcaagtggaggaaatgaggaaataattacatttgataaaaattgtagaactatttttttaaacttgttattttgaaataattatagaatcacaggaagttgtaaaaatagtacttctatgtttatccttcattcagctttcccctagtggtgacatctaactgcagtacatgttaaattgacattggtgtattagtgtaaactagactacagacctttttccattttcaccatttcatatgcatttatttgtgtaagtgggcatgtgtgtgcatgtatgtgtgattctgtgcagttttatcccatgaatagatctgtgtaaccaccaccacaatcaagacacagacacacagaagagtggtccttctgattgcatccctcccccagccctgttccctggcaaccactaatatgttctcgatctctatagttttggcattttgagcacaatatataagtgtaatcatatagcgggtatcctttgagtcacatcgtttccactctgtatatggtccttgagacccatctgggtcaatagcttgctcctatgtgttgcttagtatgtacagctattttttttttttttttttgagacagagtcttgctctgtcacccaagctcgggtgcattggcacaatctcggctcactgcaacctccgcctcccaggttcaagtgattctcggggttatcacttacaggcatgcaccaccacgcctggctaatgttggccaggctggttttgaactcctgacctcaggtgatctgcccacctcagcctcccaaagttctgggattacaggcgtgagccactgcacctggcctgaaatctgtttcttatcaggctgttagtttcaagtttaagaaaaagagtaagaaatagtatgtaggataaccccccgagttatcaagtgtaacctcccgagtagctggggttacaggtgggcaccaccacacctggctattttttgtatttttagtagagacagggtttccacatgttggccaggctggtctcgaactcctgacttcaggaaatctgcccgtctcagcctcccaaagtgctgggattacaggcatgagccaccatgcctggcctgtacagctatttttaaaaaattatttaggagtggtctcgctggaggtcaagaggataagctactggcttatgaagacctctgttgtgccaggtgtgcagtgaaaaacacccactgccacagaaacagaagattctttaaatgtaatttattaatgcccatttttaatataattgtgctcatatctgttttaggtcagtctcattttatcttgaaatgatcagtgtttaaattttgttctgccatttttaatcaaactattttctcttctcctaaaatgcccagaacgttaaatgctgtttccttctaggaactggctgtaatacataattcatatttctggattgtgatttagcaactactaactagaggctggatgataaaccgattaataaaaaacgaatttaaacagaattgttttgtataaggcaacatcaaattcagataatttcattggatttgatagatttgatgtaaaccttttcaaattgtatgtatttagggccaaacaagtggtgttatagagcagattttattttaacattggtttttattatgaagtcattgatatattgcattgcaggggcaagagactgtactgagttgactttgatgtatcatatttaacttgtattccttcatttatcaatattaagtgcttactctgtgctcagtatcatgctaggtgccagaaatacaatgctgcataaaacattctggtgaatgataaattgatctcatctccttgctgaaggaagtcatttataatggctttccaggagaaatataaatataaaagattcttgtttaaagaaaagggaagaggcaattgtagttattctctgcttacataaaaaactttaaaccggtaatactcttttttgttgttttttgagacggagtctcgctctgtcgcccaggctggactgcagtggtgccatctcggctcactgcaatcttcgcctcctgggttcaagtgattctcctgcctcagccacccaagtagctgggactataggtgtgctccaccatgcccagctatttttttttttttttttttaatttttagtagaggcgaggtttcaccatgttggtcaggctggtcttgaactcctgacctcacgtgatctacctgcctctgccttccaaagcaccaccatgcccagctaatactcttctgaatttagggatcctcttctcattgatactttagtagcaaatgcattaaaggaaagttggaaaggctttttaaatttcttaggctactgccatttctttaagtacttagtaattatatattttgtagctcaagaaactttgcttctttcttttctcagcttttctcagtgaccaataggaaattgcacttgagtatcacgtactaccatatgatgcattattttagtttttgatgtcagtttttataaaatatttacttaaagtaaataatgtctaaatgattatcttaattttaaaagcctcaagcttaattattttttgtgtgtgcttaggaacagagaagtttggtgcctcactctgaaatctgtttcttttgttgatttgtttgttcgtttgttttgttttgagatgaagttctgttcttgtcacccaggctggaatgcagtggcacgtgcttggcttactgcaacctccacttcctgggttcaagcaattctcctgcctcagcctcccaagtagctgggattacaggcatgcaccaccacgcctggctaatgttggccaggctggttttgaactcctgacctcaggtgatcgcctgcctcagcctcccaaagtgttgggattatgggcgtgagccactgcacctggcctgaaatctgtttcttatcaggctattagtttcaagtttaagaaaaagagtaagaaatagtatgtaggataacctcccgtgacacacatttacctatgtaacaaaccttcacatgtaccccaaacctaaaataaaacatgttagaaaaaggaaaagagtgtgaaggtgtattcaaaactttgatgttcagacctttcagtctagtaatttcatatttagatgattatccaaaataatcagatgctcagaaaatacagaaatattcattgcagtggcttataatagggaaaaattagaagcaaaacaaatgttcaaccatggattaactggctaagctagggttcaaaaatataaacgaatcatatacatctattaaaaataatcttatagtataatgaaggggatgggaaataattgtgttctgtaaagtgttttaaacaggttacactaagtacaattttgttttcacatgcacacatatatataaacctaaaaaaatcagagacatacagaaaaaaagaccagaagaaaaatagggacaaaattgctaatagtgacaatctgggaggtggggtcatagatgtttttccttcataccttatatactttccagattttatttggtgaaaatgtcttactttaaacagattttttaaatgtgtgtgtgtgtgtgttgtatatgcatgtatacatgtgtacagagcacatatgccaagtttttaacaatgcaataaagtggctaataacaaggacacccttctcaggcccatgggacctctgggaagtcacaggagtgtgaaggctacaggaggcagagcccacatgtgctcatatgccctatgaaatgaaacactgccactagcactgtggacacagccttcttggagtagctggctggggaccccaccatcctcctgtggaccactaagaggcatgctgtcaggcaggggtccagatatggtgattggtctatctctacagcaagatgaagcaatggcagagaggttcctctatatttaaataattataggatagcaaggacaatcaaaatagggtcattttgggaagttaaaatacttgtgagaagcaaaacatataataaatattgtttcttttgttttccagatattttatccagaaacaacagatgtctatgatcggaaaaacataccaagaatgatatattgcattcacgcactgaggtagggggaaaatgcagctaaaaggtgctctaagaagtagatttaaataaaactaaaatttcaattttaaaagaggttttaagttactttaatagtttgaagaactttttattaaattccattgttttggatttgctggtacaaaattaaaataatggtcacatataagcaattcttgaacttgaaaaatgtttttctgatttttaaatctaactcaaaatagaaaaccagaaaatgattgaaaaccattaagtacaataaagagaaaatttaggttgaaacttctagaaatccaattgtaatgtactactatattcttgagttatgacctagtttacaaatataatgcagatatatcaaatgagcaactttaatagtcataattttggtttaatgagttaaaattataatttagttcaattcttacaaattaagaaaatagaggtaagaatggtttcttttgatcttctgttcaatagaatttgtaccctaaggataaagaagaaacatagtagtttggtgtaaattagtcaaatcaagacacattcattattttaaagcaattgttcaataacttaatttttgaaaatgctgaaattctgctagttcacagattacattttatcttattggcctggaagaaatgtgatttttagatggtaacaaagattattctaaaaatccagtttgtggctgttgtcttgaatgtacacaggtaatggttttggaagacttcatgtctgattaaattttaaattacttttagaacatctgccttgtgttttcatcactagaagtcattttcctggcagagtactctgcctagaggtttatgttgacttcttcctggctcttttcctctccaaaggaaaatgcttctacaataattcatggtggtgttggctttctagagaagaaatttgattatgtcatataatttgactttttcccccagtcagtacttatgggattgctttggaagatgacagttgctagaaatatagaccaagtgtaggtgcctttgctatgatttttttttattctagtaacttagaacaactggttaaaaaaagaaaaacagcaacagtaaaaacaaacctacttcatgctgccttctcagatgtggcgagagtatcattatgccacaggttttctaaaagctccttgtgcaaaagtgcttatgttgaggaatattttcaacttgtgttgcctgatattctttattaaatatttttctgatcttagaatgataacactatagttagtactgggtctatgagctgctaagccagccacgactagttaatgccattgctacatgtgtgcatcacagtgctaatctctagttctgtcgcatgctcgtgggctgtctcgtataagtttcaattgattttctgaaatagacaactgggacattcatgttaaggagcttataaacaaatggtatgctaagttcctttctggtgatatcatggttctcctaaaggagctatctagagctgcacttagacttacatgtgtatttgccatggttttaacaatggcttgaatagcttggtaaacaaagaaaaaacaactttttgtttattattaccaattgtatacaaatattgatgtgatattttccaggactgtgtttttcagttattcatcatagacatctccattacttttactcatcctggaggggattcctgttgggtcatgtcattcaccagatctgatcttaagtaggatattttatcttcaaaagcaatatttatttagtaaatagcattctcctcgcttttctttgttctaaattattgtatagctgcctctcactatggagccgagaagtcccaagtgtatcttgcagctttttccaccaaaacttgttcctgctatgatttaaaatgcagtcagtcactcaaaggaggctgatattctgctttgttgtgcaagacacatttgaaagctgaggaacaatcctctaataaatacagtgggtttgataaatactcttgctgcatagttagaaatgatgatggaaatgaactaacatgtcttcagcttttatatcctggctgcaaatacagcactgctgctgtatttgagagttgttattacctggtagagtaattaggcaggtcagagattctgattataactcagaagccagcaaggaagtttccctaggaagttaagcttgccaggcgctgccttcttcctgccccagcctgtgggcctgacttgatctaaaaagttagctcttagccctgaccaaacttgtctcctattccctgtcatcttgatttgggcttaacaacctaacttctgggtgcttatgcttgcttcctgtttgtatctgtgttcccctttgctgcctgcccctcaccttatcattttatttctgatcccagtctcgtgtcctaccactcaccaatccctgtgtcagtttagcttggtgttctcaagccagactccatgaacattaccacagcagcaaagggaggaaattctcaagcttcacctaatgtagacagactcaccttagcggtggatggcatcttttttttttttgagatggagtctcactctgtcaccaggctagagtgcagtggtgcaatctcagctcactgcaacctccaccttccgggttcaggtgattctcctgcctcagcctcctgagtagctgggactacaggcacgcactactatgcccagctaattttttgtatttttagtagagacggggtttcaccatgttggccaggatggtcttgatctcttgacctcgtgatctgcctgcctcagcttcccagtgtgctgggattacaggcatcagccaccacgcccggccacatcattctttttctaaagaaatgtttgtctttttctcattttttcaaaagtaatgtatgctcattgtggaaaaaattggaaaatccaggaagaatgttaaagaaaaagctaaaatacccactatctcaacaccaagtaaaaaccactgtaactattttgatatctttgaacttaaagtgtatactgcgtatggcatgttttacttttgtggcttcttttggaatgttataaagcctctgccttgaaaaggaaccagtttaagagtgagagccttactaactagttactatactaatttttaaaaaatatctggaggccttttacgtaagggtaagaacacttttttgacatgttgtttagtgcccaccttattaaagatgtataataaatgatattaaacaactgttacttgtttaaacagtcataaaagtgagttccttgaaagagttggaataatttagtagaaatgatgttttgagtacttcagataccttaaagagcaggtgaaatgcccaggtacgttattacaaacttactacactggaacctattctgtaagacccatactacaagtttcactcattttgtttattatttataactagttttgagttgtccttggctattatattattttgatacctacccagaattgacataatcttcgtggcaccagaaacaaaagaataccctttcaaacctgccatgattacagatctgggtttcggatggatcacttgtgagtcagaacatggcgcaactttgggttcttctcccatggcgagtcagaccctggccacaggcatcaggctaaactttctttgtttaaaaaaaaaaaaaaaaaatcagaccgcatttaagtacccggctttcaggtaggtctttatttacaatctggtccccacccctgccccccttccccattaccctgaaataatttactttcttaagtctcacttgaccagcattgtataatccattgtcctgtcataatgatgtattggcctgatccattaacattattaaaagcttatgtatgccttttaaatattttttttttaattagttgggctttctagaggttttcatcccctgggagacaagggattgactgtacccagtgatccttaggcttttgggctgatttatcatctcagatcatgtttctagtcctgcctccacttagttagtggatgtgaccaccagtgctggaccctctttctacccggtgtttctgtcaccacctatgctccttggttcttccttatcttggggcacttcctttgttttctgggactatttagtttactcaaagttcttggtctttattctttcatgtagtataaatagtataaaaatatctatatataaacaaatataggccaggtgttgtggctcatgcctgtaatcccagcactttgggaggctgaggcaggcagatcatgtgaggtcaggagtttaagatcagcctggccatgatggtgaaacctcatctctaccaaaaatacaaaaattagccaggtgtggtggcaggtgcctataatcacagctactcgggaggctgaggcaggagaatcgcttgaacctgggaggcggaggttgcagtgagctgagactgtgccactgcactctagcctgggcaacagagggagactccatctcaattaaaagaaaaaaaaaaaagcatggtggcacacgcctgtagtcccagctactcgggaggctgaggcaggagaatagacccaggaggcggagatcacaataagccaagatcgcgccactgcactccagcctgggcaacagagcgagactccgtctcaaagaacaaaacaaaacaaaacaaaacaaacaaacaaaaaacagatatagaagaaacaaagtacttgtgttttaataatgctccccaacttgttaaagtcaatataaatacacattcgctatttatctcttttttttattacaacttcctttttggacactgtatattattctcttgattattgttttgaacctgtggcctttctcagacttaaccaagattaatatctctttctttttgatgaaccagattgtttcagcttggtcagtctgagctctttctggcccacttccttgtccttctagcaccgtccctgacattctttgaaatatccttgctcgtggtcacaacaggatgttccagtcctatcctgattatttctgctttgagatgtggaaccaccactctctagggattcctcttaaaagtcatgtgtttatattaatttttcaagtttaaccttattagcttactggattctgcttttcttgctgtctagttcatttgaccattgagattcttctacatgggcagccacaaacggaagctatgtctgcctctcctctgtgataggattactcttcccgctgctgatactgtagctgtgtcgcagcagccatgttttcaggtgcaatggtgatgccatggctctggcagacccacttctggttcaccagccgtccaggtactctgggagctttgtggagtagagtttgtctagccagctcccacacagccaggtggctgtcttgcttaccaggtggcctttgaacctgctcctcaggcattaatgcataactttccttgtcttaacactctgttcccttagaaccttttccttccctaagaaactgattgaacccttatatcagattgattatatctctaacagtgaacatatttgcatttataaataagatttccaaagacagtttcttagctcaaaggacaggctctaatcctaggttctcagaagggatatctggagatggcagtatttggaagtaaggtgagggaggcagttgcacctgcttatttctttcaagtccttccttgctcagaattctctctgtgctctgaaccattcctttccctttcctcctctttctgtcctaaattagtatggtggttatgcctttctgtcttcctaaattctgagctcttaagagactatgaaccacatcttgttacttcatacagcttacgtgctattgattccaagttaaagtctctggagtttgtatatttaactcttcaggaggtttaattgaactaatttctctatgataaggctacctcaggattcctttggtttggggctgaaaattaggtatagaaccctggattttgatatgatattggcagtgatatatgtgactaagatggaaaaatttggttcagtaaataaaactatttcaaacatggagtctgtggtgaaatagagattcttggcattggaaaaagtaagaaaaccactttgataggttatcaataagtgtttgtatacaaaggacacatttatttaacaaagaatagtaagaacaaaggttaacacaaatggagcttttaactatgtgcctggcactgcacaaaatactgtactggtataatctcattttatcttcataacatatctgtgcagtggtcactattattactcccattttatcaccaaggcagttgaggcacagagaggctgccgaaggtcacacagttagtaaaaaccaggatatgtgagaactgaacctgtgctattatgaattcagccagccaatggcttcaaaagaagtcaattatttccctacttctaagaaaattaaaagaacactggtatcagacttgaacttcagcacaggcctctcagctattatatttaacatgttttaaatgaagaatcatggaacttgagaaggggaagggccttgggaagttattgtagtctaagtcattcatttcacagataagggaactgaaagcttgggttacgtgacttgctcttagtcacacactgaggttttaccagttttgggaccaggattcagcgcttctggattctagtcctgtggtctttctgctctaccatgaggctttgatatacaaacattcattccacatgttatagtacaaaatgagctacacataatgtgatccaagaaagctgaaataaatttagctcctgccttttaagtttgcatttcattacgatagtaccttttagtgtatatcctgaaagtatagaaaaaactaataccactagttttatcttgaaagtggtagaaaaaactaatgccatgtgatattggcagtaatgtatgtgactaagatggaaaaatttggttcagtagataacaactactactactactactactatatactactttcatgatatacactaaatggtattttttaaaactttctttattgcttcctggactttaagtgatattatttgtacaagtaggagcacatgggtcaatgagtcggtagctacctctgggcaacccctccgttgctggcctcactcagctgcacaggtgtgctgtagcttttggtgtggtaggaggcttgctacctcacaaaaagtgctctcttagacatgagaagcaaaggtgacattaattccatgacttcctttggaatgctctcagccctttgacttggctgttaggtaccaaacggtgcttaataaattaactgttgaagagctacatgagattggcactttttctattcgatgggcttttttgttttttagattaagacttgatttcctatatacttcaggtaataagcagcctcatttgaatttaaatgcttgggaaggaagtttgctattgctgtttcttttcagcatgggaatactgggtaaacacagtttcctgataaacatttgcccgtttgagtaatcagctgggaagcacctcccacacagagattaggtgtaaaacgcccataccatgaaaagtgatctttccaaagctaacagtttaaacctcaacatcaatgatttaaaaaaaaagaaaaaaagttgaaaattgaggccaaacagaaactatacaatattttttttaattttttagtaaatgagattttttgatatatgcaaatgagatctttacctgatcaatattagcttaagaaaatatcagacttaaatttaaaagcaaagattcttccatgttcagaaagctaacttctcagcaccaccttgtggtaacttttacttaagccaggatgtttgtttattgtaagatttatattaatattacattgtacaatggagaaattaaaaatgtaattggaaatagctatctaacttctttatcatcaaaggggaaaattaacagtttagtataaacattttacttcatgttatcatcaaacctatattttgtggtagcctaagtaccttaatttagggatagcatggtagagaaaattttttttttttttgagacacagagtcttgctctgttgcccaggatggagtgcagtggcacaatcgtggctcactgcaacgtctgtctccctggttcaagcaattctcctgcctcagcctccctagtagctgggattacaggcgtgtgccaccgtgcccagataatttttgtatttttagtagagatggggtttcaccatgttgaccaggctggtctcgaactcctgacctcaaatgatcgcctgccttggcctcccaaagtgctgggattacagacgtgagccactgtgcccagccgagaaaaatatttttatataggagctgttccataaatagtaattaaatgaatgaatggataaacagagcataatgtgaaaacagttgcatcaagatcattgagcacagctgtcttatcccctttccaaaactaacatgaaattaactacagtaataacttttaaaaaatacatttgcgataaaaatgccatctactaaccagaaatttgaacaacccctaacatgaagtaaacagacagaattcgattgactgagaaacaaactgggagaagatcacagcccacaaaacgctgggggttgcagcagaggtaggagctgtcgtgaggtttgctccaagcaaaggggacagcaaggaaaagaagagcctcaaagtgagcaatcgtcagcctaggaccagcagaactatatggcccttccctaaagcagcaagtgtagatgctgatagcgggatagcatgccggtacccaagacagctaatgacctcaagaaggaacagagagtccccagtctgagaaggaaagacactggttcccttctggcgtccgttccattgctctctacagcttcttaatgctggctcctgacatgcggatctgcagtgaatgaccaacaaacagcaagtctcaaacactaagatgagtcccagatcagaagatgtcagacatttgaaggaaactgccactgaaggaagcattagattcaccaaacagaaccaagacccaaggaacaaatgaaaatattaaaatatgtgcaattgatgattcattcaatttatgttcaacaaatatttattgagcacttacatttatacacagaagaaccaaagataaaactctaagaaggaaaatttggtatagataaaatcagaaaaacagttaataaaatttgtagatatctaaattattggtggatataattaaaaaagcatgaatctaaaattctaaattatctcaatattccacaggtgggaaagttagaggtggaagcatctaaggataatagataccaattagtttaggctttgatagaaaaatgtaaaagtatattaaaacttcagcaggatattagtataggtaatatatattaaagatgcagcacattaagtacttgaaataagtataaaatttgttgcttgaagacattttatggatgtctgcttacattttactgtataacattttctaaatttcactttttttatagttttctttgtaaattaggtatatttttgaatttgtaaaaagaggaggaaagtgcaaatcaggtagtatgaaagaaattgaagtgatacaattatacatttttgattatttgttcatctattctcatttctttttttctttttttctttttttttttgaggtggactttcactcttgctgcccaggctggaatgcaatggtgcaaattcagctcaccacaaacctccacctcctgggttcaagcgattctcctgcctcagcctcccgagtagttggggttacaggcatgtgccaccatgcccagctaattttgtatttttagtagagacagggtttctccatgttggtcaggctggtcttgagctctcaacctcaggtgatttgcctgcctcggcctcccaaagtgctaggattacagtcgtgagccaccgcccccagctatgtattctcatttcttaaatgatggcttgatctccattcaccccccaaattcttttgcagtttatcttgcctgttaaattctgtttaattttgtcgttcccattactagaaaggagcaagtgaagaggttgacatttcattgttccaagtaatatgagcacccttttaactggaattttttccctatgtaataatgagttgagaattggttcataaaatattatggttttgaaaatgtcagcatggtatcttaatgatctagctttaattataatgacttgttggcatgaacctttggtagtaaagtcttcagaggctgtgtaaagtaaacagttttatatccatgataatgtctaaagacctagaactttaactaaggaatgtatcctctcttgctagtttgggattatgaatacataatggctatttcactttgaagaatgttcaaagtctaatataaaactttttcctctgtggataagatataaatatcacattgaaatttagtattaaaactaatgttacacatatggtaaaaaaaaaaaaaatgttctttgtcctttgctatggttttaaaggaaaagcaggaaaataagaggcaaattcttcccctaaaaattctttaaaattcgaacattcattaataggcatttcgtggaagacatatgaatggccaatgcatgtatgaaaaaatatttaccctcccaaccaccataaggaaatacaaatttaaataacatcttgttgctatcagttgctagtcccttgaaagactttattgataatatcctgtggtgataaggggacaaagaaaatggcattcagatgtattcgtggtctagtgggccatgcccatcggggttcttaggtttagctaaatattcagattgacccacctgtcataagccacatctggcacctgttgctcagaagagaggtagctgggatagccagcatgctggcaggtgttgctcttcagtgggagcctgcgtgacactccacttagttgtccatacaaccatctggaagccaccattcttggtaccccaagatacaactttgctgctaagaagtgggtttgagccttcctggcttgtaagcctcgtgcccccaggagccaatatctatagtaacagctgtactgcatagcttcccagttctctgcaaagaacataccagttataaaagtcattgaacccaggaaggcccaaagatatggtacctattaggtatttatggttttttctctcaagatacaatttatcaattgggttattttttcctaagcaatgatgcttataacactgttgacagtataggttcctaagagaacagagctagaaagttaaccaaaggtcaaattctcatataaaaggaaaaagggtgttttttaaccctttactcataaagaataaatgagcataatctctttttaagatcacatttggacagtaaacattgaaaacttttattgtgtgtgtaccctttcaagctggcaattttgttttcatggctttattgtaacaaatacgaaatatgcacaaagatgtgtctgtgtctatatgtaagtaggtttattaagcattatttgccatagttattaattaataacaatctaaatgctcagcacttgcttaagaaaattatagtacattcatattctagaataatatatacgtttataaaataggtatgtccagaaacaactttaaaagaacatatataccaaaatatttagtgtgtaactgagtggtgattttctgtgtaattttttaaaccataagccactaattttttactttgatcatgtattacttttctaaataattgctcttcataaaaattaccagaaaattggccagacacgatggctcatgcctataattccagcactttgggtggcagaggtgggtggtcaggagttcgagaccagcctagccaacatggtgaaaccccgtctctactaaaaaaaaatacaaaaagtagacgggctctgtggcatgcacctgtaatcccagctagttgggaagctgaggcaggagaatcgcttgaacccagaaggtggaggttgcagtgggtcgagatcacgccattgcactccagcctgggcgacagagcaagactctgtctcaaccaaaaaaaaaaaaaaaaaatcagaaaattattgtcagttttaatgcaagctacttacattaaatgactaatcatacattttaagagtttgttttaataccattaaaaaagcttgatcttgaactttcttaatgcatttaatgaaattctatgttctataaactatggagcttcatctcacatcaacatctgaagtgataattttgaagtatttcaagccataaaaatcattcagttcactttctcatatatactattacttgaaactatgactcagtgataaaagtggggaaagcacatatattttttatagaatttagatgccagctctcaagttcttttctcaggttatgggtaggttaatggatgccatcattactaccttatggatttgtttttaaatacatccaatttattctccatcttccacttgggtaatatacacacatcatagtttaacattacctcacccactgatagtcttgccactctatttattggtttagaaaatgtaaaacaaatatttcctcaaggggtatgtggtacttggaggaatattaaaaagcaaaatataattcatgctgtaccttcaataaaataagaattatgtgaggaatattcaaagaaatgtttattgcatttgttacctgctgttttgtattagctgtgtttcttgttctccatacaaatggatgatgcagagttagctggctctgtagaagtgctgtagaagtggattacagtagaagaccagtctttgggacacagattggaattctgatcctggcctcaccaagtactctgttacccagagactcagtttcctcatttacaaaatgaatagactagatatctcttaggtcttttcaactgaaaaaactattaagaattatgtaatttataacattaagacttatgatgataaaatttctgataattttgtgtttttttctttcagtttgtatctgttcaaactaggaatagcaccccagatccaggatttgttgggcaaagtagacttcacaggtactactctttatctttgtaattttttacaatctagttataaaaagtaccaatacctggccgggcgtggtggctcatgcctgtaatcccagcactttgggaggccgaggcgggcggatcacaaggtcaggagatcgagaccatcctgactaacagtgaaaccccgtctctactaaaaaatacaaaaaattagccgggcgtggtggggggctcctgtagtcccagctacttgggaggctgaggcaggagaatggcgtgaacctgggaggcggagcttgcagtgagctgagattgtgccactgcactccagcctggacgacagagcgagactctgcctcaaaaaaaaaaaaaaaaaaaaattaccaataccttttttccccattttgatattattgatttcccttattcctgtatattgatgagaagagaaaacagacctatcttgtttgttcttgactgagttctccttctccatgtttgtgaaatgagaaacttgggctaggttcttcctaaggctcttgtttacaaacaaccccacttcctgatgaagacatttcttgatatgattgtactcattcctgcatccatctctgtctgtagctttctctgataatgattatgattattttgttctttgttagaggaggaaatcagtaatatgagaaaagaacttgagaaatatggaatacagatgccatctttcagcaaaataggtggtattctggccaatgaactgtccgtggatgaagctgcatgtaagtccattcaaaatccaaacttgccatggatgtgagacttacctgtactttacctattgattttgattactcgaaatagaatatttagaagatactttaagcaccctaaaagtttttattatttgttttatagatgattaatttgaggatgtcagaatataaccaagtaattgattttggtctttagacttctacttgtacaacatgaattgaggttctagaaataccttcattgtccatagttctctactttctgtgtctgtagattttagtggtagagttcattgttacaggtcttttagtattgcaagctaaattgcaagtatttcttggaaccaacatgttactttaaaattacccatgtcgccctgaccagagggcaaggattgacttaccttctaactcctgtggttgacatagggcttgcttcattttagccattcagtgatgtataaatgagtcagaattacttaacagatgctgagatcaggaccaaagacagccatgtggagaggttgtcaggtgctccataatatgtctcagttctctttttgacatatttactggaagccaagaaagaaagtaaaactgcttgagtttacacagggtcaatgcaactgtccatgttgtcttttgctgataaaaacctttttctctctctctctttactttttagtacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaaggtgcttagattctgagtaataaaaacagtaatgaatgtgcttatgagttactagtttgaaaagccttaatgttgaaagcaatacttttaaatcaattggctattttctctatagccgtagacaattgatttgaatgaaatgtagcatacaagaggaccatacactaggtaaggcaattagattatatccctatataaggcataaaaaggaattttatagtccaggcatggtggctcatgcctataatcccagcactttgggaggctgcagcgggagggtcctttgagtccaggagttcaaaacgagcctgcgcgctatagtgagaccctgtctctaagaaaataaaaataaaaataaaaaattagctgggcttggtggtgcaagcctgtagtcccaactactcgggaggctgaggtaggagaatcacttgagcctgggaggttgaggctgcagtgagctgtgaccctgccactgcactccagcctgggcaacagactgagaccctctctcaatttttagaaagggaattttgtgatggatgttatatattgacagaattaaaagtcatgttgcaaacttactaatgtccccaggaagtgtagaagtagcaactcatgatcatcccttgttagacatcaacagaccttacattagccaagttacttttacatttggtagtagaggttaataattcagtgtggtgaagttcagagaggatgtttttgaatctacagtcttcatattttcccaatagtcaatcctttatatttgaggatgtccctcctgtacaagacagcctgctcctaatcgtaactccatttgtaaccacctttctgtgtagtccattattgaaaaatttgtctacgctgagagcttctacttcctcaccagcttgtctctcattaagctcttgccatgtcagtttcagctccatgactgaaagtaaccactttaggttttggcattttctcaactggtggcttccaccagcatctggcagggttggcctcctaccttgagattctctgcttcactagcttatgtgcgtccttgctgccacagttctcctctgtgcctctttctcctcttccttctccctctcagtatggggattcttcaaggtctgacatggaatcccttctctgttcttcttccattgagctcatccacttgttgaagaaatcagccatcagctttatgccagcccatcccaaattggcctctctcctccttctccagataactttgtctgtgtccctctggctttgtaccccattatatcagaagagttccccttgctgacttccctggttcagaatgatggccgggtttgtctcagaactctttttatgccccctgtgtcccatgcattgctagattctgctgcctactcttgttggagttgaatctgtcgccaaccttctagtctcaccagtcttgcctcagtcctgccccttctgacctcattgcatgactcttctatcaagcaccttccttgtgggtctctctgcctcctgttactctctaagccaatccctcttaaagctagaggttacaaaactgatctttaactacaaatcttgtgttaacccaccagagacatgccccgattctctattacctactgaattaaataccaaatcttagcttagccttcagctgaccccctcatctttttggctcaccatggacacactccaagctgtagcctaatgtgctaagctttccatctgtgtaaccaaatcctgctgtctgtttcctattcttgacattattctgttgctcgaagccctcattgattatgatctctttgcaaaattttcttcccaactaagtatgaatactttcttaaaaaatgcttatagtacttctcttatagaacctattctgttcttctaggtatatttattacttgtgttcttgattttattagatcaaatcaaatgaaattggcactattcaactgtttttgatctaaaaaaagggcaataccaagtggtccaaactaatgttttccacatttgaaaattagcccttttcaaagagtcaccgggtctgtcattcatctttgtagtctttgccagcattctcccctagtcccctgcacagagcaggcactccacaaatgcttgcaatgaatttaaataattagggaatggtttttgtcactcttcacatttttccatttgaatttcgagttttggaaatattttatttaacctcagaaatcagtgaagactttgttttgcagaatagctgtatttcagaagaagaaagagatgcttatgaagaactgctgacacaagcagaaatccaaggcaatattaataaagtcaacagtaagtaatggatcgtatgaaggaaattgatatttccgtaagatacagactttccttgccagaatcccaacacaactctcaatttgtatacttggaaaactgccttatacaatgaaaaatctactcagtgtcagtgttgctcttaattatggtgcagcatttggcagtttcccactgggctttttttggtgatctcagtccacacaaagtatcctgaagctagtttgattctaccttcctgtttcattacattccacattttaattctgtcacttttggggctaatactgaaggtcatttagtaaaagattataatttacagattgtagttgcttgcccatgattatgcgatgatgttctattggaattgtaaaaggtactattgacaccactgctctctgtgacttcccagccattagtctgttgtttgtaagatttttcttacacttgtgtaactttggtgccagtgaatgggactatggacaggccagatgaaatctcatgatggcagctttgagtcccacacccctgagcctctgtggagtcaagcagatgagttcctcttagtacctggctcaagtgtctgattgtaaagaacagcagactcaggtaattaaaataagcgtatgcaggttgagatacatcaatttttttattagtcttttctcccctctggcaaaacctatttttacttgagcatcagaagagtcagtaagaaatttcatttgatgtttatttttccctggtcaatctagataatccatatatacccaaaaaactaatacatgaaaggccatttagcctgcttaataaagcatgtgaactccctgcgaaattaaaatttggagtatccactaattacaacagtcctaaaccttgccttccttttaacatcctcgttgagttttgaatattcttttttgcttgtaactcttgcaaagaagtgtacacccacggtgttactaagaagtctgctcctaaattgctggagagaaatatcctaaggggctcaaacagtaattaaggaaagccccagagggttaatgtaaatgtctaggagttaacaactgaatgtgtttgagaatatgcctcacatacacataactgggctgaaaactctcaattgcctttatttttttaaggtaacaccttaacattttagggtgcatgtgcctgttgttttattcttgtgaaatcttgaacatgttactgatgatacatgaagtacaatttaaagtttgtctttttgctctatgcgaaagctgagaacttcgtgatgcttgacagaaatgaattacaggaggaaattaatgttgccagtgagacatctgaggtccataagcctagagaggaaatggctccatagcctttaaccatcctttatttttgaaatatttataaccatgaaaacagttttctttttcatgttaaataaaatgctttatataaatgttttagttctttactcagtgccataatttcctgaccgcaaatttaatgccaaattggctatactttttttttccatttttaagtaaaaggcattggatgttttgcactaatggtaaaaccggctgaaaatatgaaagcaaggtttgatggctttaaatgtgtagaacatgattattctgaagtctttttatctctccccatcttaaaatttatagtccagtagaactgaaagtaaccttaggaaaaaaaccctcattttgatgacatgacaatgagacaattgtacactttaaaatacgtaagaatcagctgggtgcagtggctcacacctgtaatcccagcactttgggaggctgaaatgggtggatcacgaggtcaagcgttcaagaccaccctagctaatatagtgaaaccctgtctctactaaaaatacaaaaagtcagccaggcgtggtggcgggcatctgtaatcccagctacttgggaggctgagacaggagaatcacttgaatgtgggaggtggaggatgcagtgagctgagattgcgccactacactccagcctggatgatagtgtgagactccatctcaaaaaaaatttaaaaaaaaaaagtaagaatcattactttgacaagattttcctcaaccatgtaggttattatattaaaatgttaaggcatccacattcatagcaaccatagtaatagcatcagtgacaatgttggtggtaatgtcaacagatctgttgttagaggcctcagctttgttcacattataaccctttacctttcaggttcagcaaatgcattccattcattgcatgatattttctgttaagatcagagctggacattttgcatttctttgcttttttttttttttttttttttttttttccggacagggtcttattctattgcccagtctggtgttaaactcttgggctcaagtgatcctccttcctcagcctcccaaaatgctaggattacagacaaaagctaccacaccctgcctggacatttcgttaaatgcagagtgtaaaagagtggttgatcttaccttatttttttagaagaaattgtttatttaatagtgtttttcaggctaggtgcagtgactcatgcctgtaatctagcactttgggaggctgaggtgggaggatgacttcaggccaggagttcaagaccagcctgggcaacaaagagagactcagtctttacaaaaaaaatttaaaaattagccgggtgtggtggcacacaactgtagccccagatactgtagagactgaggtcggaggatctccagagcccaggaggtcgagactgcagtaagccaagattgcaccactgcactccagccttggcaacagagcaagactgtctcaaaaaaagaaagagagagagagagagagagagagagagagaaaacagtgttttaaagacatgattttctgatgtttgaaatatagctgtacaaacccatataataaatttatcaaaggtaaagcaagatcctacctagagtaatccgagatacagctgaaaggccttggagtaactttagcagaacagcaaataccacaaacaaccactagccttcctttctgaaattttttggtttgtcacattaattttaaagatagaaatgctaaggttctcagggtcctttaggttaagtgtgagttttctgggggatgacttgaaggattccattaatcataagtatttcctgttattgaattatatctcttagtaaaaatattgagggaagatcctcgtgaatgtatttagagaagataaattgtcatcttgtcaaaaagggttagaagaatcttagctgcaatctagtcacgaattaggcagacaggctaacccttgaaaggctctaaaaatgtatgggtatgtgttacttctgctacccagatgccttctctataaggcaaaactctgcaatctctgtctgatttgctctttcctggtggcagagttcatcattcattctcccatttactcagcaatttcatttttgttctctgaaaactatgctgaatctactgttccaagcatctcagtttggtaaccaaaattcatttctttataatctgcaccttacaactggttgagagatcacagagtgtattagtccattctcacactgctataaagaactgcttgagactgggtaatttatgaagaaaagaggcttaattgactcagagttctgcatgtctgaaggaggcctcaggaaacttacgatcatggcagaaggtgatggggaagccaggcacatcttcacatgcccaaagcaggaggaatagagagaagggggaagcgttacacacttaaccgtatctcgtgagaactcactatcatccagggggaaatccgcccccatgttacaatcatcttccaccagatccctcctccaacattggggattataattcaacataagatttgggtggggacacagagccaaaccatatcacagagtttatggttgtctcagatgttgcagcaatatgtccgagtgcttgctgtaggcttaccgcagtgcttatgtgttaggaagatataacagtagggcaaggcttgcttctggtcttcttgtcacttgaagtctccttggggagacagtactaatgcacaaggagcacagggaacatgcctgctggaactacatggcccagctttaaataactatggtgttcacatgatgagaaatccttaaggactggagcaatctgaaggcttcagggaagaaatgagaccagagctggtcctataaggaaggattttggaaggaagtcatgctactcaggaatgatctcataccctaagctccatcaatgctaaggttcttgtaggcactaattccaaagattggattagtttgaattactgagataacattttcaaagccttacctaccctctgcctgcagcttttcagagttcatgaaaagtaactgcttaggttcaaatccttgggaagaagggctggttgggtgagactgcagtggaaagagcaaccattctgacaaaacatgaacccccatcctcagggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatggtaagtcagaggagaccccagctgtggggacggtaaccctgcgtgccatggcgcactagggaagcctagttaggaaaggggaatagggatcggggatctctaatttgtaccagtcctggtctcactggcccacctgtaccaattccaaggccttcttccttgttaattcttgcttttagtctacataaagaatctaagagcatagttaggaaattccagcagtggtctatacatatacctgtgaaaataggttgttcttattttctgtgtgatatttgaagacaccttggataaattttagctataccgatgtggtattttttttacaatatataatgtttttatgtagaaaataagctcaatctgcaattttagaaactgcaaataagaccattagcaccatggctttgatttttgtgaacttgtgcaccttaatatgacaacagcattcaacaataatttcatacaaggttacagtaattaagaacatgtttactaacactcttgtaagccaaacaatgaaacaaaatgaaaactactgaaagcagaaccaagaattcagcatataacaaggctcgtatttcaagaaggtggggaaacaactatttaataaatgatatccttgcaagtgtttaagctttgttaagaaaacattaactcactacacatatatcaaaataaattttcaacataaaatgttaaatataaaaaataatttaacaaattaaagttctaaggaaaaacacaggacagtcattggatctttaaagtcacaatcagcacttatccacacacaataaagagaggccaaaaacatgagcaggcaattcataaaacaagaactatacaaatgacaaacaaaaaaaaagtttaaactcaatcagaagtaaaaaatatataaattaaaacacagtacacttatgatttaaaattagattggtaaagattagaaagatttaacccagcgtagggatagatatggggcccaaacatctcctacacagctgctgggagtatgaattatacagattttctgcagggtggtcttagtaatacagatcaaaagcccatgatgctgacagttacgttctagaaaataagcctgaaggatatgaaccaaatagctttggccacagagatgtttcacagcattgtttagaatactgaaaaccaggaaacaaatgtttaattaataacagattgcctataaattaataacatttatggtgcttgtacatgtgagaaatatgtgcaaccagtaaaaatgataatgtaaagaatgactggaaaagatatccatactaatattaagtgggaaaaataagattaagatatatagcattatcttgttttttgcaaaaagaaagtgaagtcagttataaagacaaaacctctgcaaatgtatatatgaatttaaaatacataaaaggatatacacaaaagagcttgagtggtagcatttgttttcttattcttgcttactaagacttctgtattggctgagtgtggtagttcctgtctgtaatcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattcaggttctctcattaatattttcttccacttctctggctctgaagctcaaggctacttatgcttgaggacactcattcatcctcaactggccatagttaacctgtggctgtccaacctcatttcttcttcctctctccttatcctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgctctcgatggtaaccccttcttcccatttgctttgaaagattaaactatccctttttattctgaaatcagtttgctgcgagacttctgtggagatccagaaagatataataatgcattttaagatgaacattatgttatatattaaatacctgtaatatcctaaatgtaaaatatgtatcagcttttccttagtggttctttttcatgctcctgctccttatgtcccttcaatatgatgaaaaaaatattccttttgaagttgggccaagataatataaaatggttaaatggaagaagatattaaaggggaagggtgttctgaaatctaagacgtatttttttggataagctaaatccagattttaaatcatataaacctggagatctggccaggtgtggtgattcatgcctgtaatcccagcactttgggaggctgaggcagaagaatcgcttgaacctgggaggcggaggctgcagtgagcctagatcgtgccattgcaccccagcctgggcaacaagagccaaactccatctcaaaaaataataataataaaaataaagcaaaccaaaccaaacaaaaaaacctggagagctttacttgctttaccaaaagatcacctcagatttcttcaaatatcttgacctggtagtgtattttaaaatttctattttaaaatttatgaaaatgtcactttaactttttttgaattaaatcagtagtcttggtttgaagaccttgctttgtgcttcagattataacttttcagtgaaattctcccaaccttcccttaacccttaattcaaactggaaatcgttagctgtgctaaaatgttacctggcactctcagtcagtgacaatgttatctagtccttggcttaattatatggctggactgagcctttaagcaaccagtatagctaggagtagggatcagcaatgggaatgcagatatttgtggaatcgtaacttttcattgtaatcaacccagtcccaaaaaatgatcatctaatgaaagcccaggagccatatacctgttcttaaagccagtggaaagcaggtggccacgactcctctttctgctgagctatcaagttctttgactttttgttgtttgttgaaatgtgcattgtaaacctccatcatgcacatgaggtgtgttgtgtggggagcttatgttgccatatgttttccaacagaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacggtaaggaacattttccaaaccttctttcaatgcagaaatgcatgtttggcagatcttaaaagtgaggaatttgcctgttggtggagaaatccatataccatgctcatgtttcttgaaaactagtctgttttaagagtccttctaattagtatccttgtttacagtattccttctggggaacaagaagaatcagaaagtgatcatcctgtggcaattaataaatgactttgtcgttggcaaagattatttgataggctgaaaataaaggaactattggaaacatacctttccttgggcgtcttttggaaaccgcagaatgtagaagagttggaagcaactttaataatcatccagtccaattcttttatgtcactgatgcagaaacagaatccgggttatggacctaaaattgggcagttgggccccaaactccactcttctgattattaagccaaagaaatcctgagaccacagtgggtcatggcagtgggtaacaacatccatttatctttcatttcatgtttctgaagtgtgctaccagatagtacaactgatagcattgttataaaacactatagcggatcttgagagaaaatcaaatggccagaattgggagccagatgagagagtcgctgagataaaagccccagttaaaatgagtgaatcttggattcttgtaaccaccagggggagatgtctgcacagatcttgacaaaagctcttttcagctactgattttggaacggctctaataggcaggttggctaattctcttgggtcatgtacagttgccaaggaaaaaccagagatttcttaggttaaacaaatggtatttgaccacttgtctatgtagtgaatggccaaaaggtaatggaaggatggtgggttttccttgtttttagtctttttggagaaactaattctcttgttctacttaaatttggccatctggttcatatgactccttagagtgtgtttccaaggtaatttatatctaccaccactgtttctgttacttgttaatggcaccattctctcctgtaagcttagaaacctgaagcccaatttgagtttccctctgccctcagccgggcaccctcgtgctctaaagagcctgctgtcagtagccagtctatgtgccttatacctctgcaagatgtttccatttccctgcaaccaccctcacttagacttctcacttttgcttctgtagtaacccctaaattggtcatcctacttcttttctctccccattcattaatcattcctacctaaccaggctttgccatactttctcagtgctagagtagaagacagacccggtcaatcccttatgaagcttacaggctaatggggcatcttggtgagataactgtcaagactattccacatatttagcatccctggcaactgtcctccacatgacattagcccctgactcacccattctgattatcaaaaatgcctgcttcttcatttacaaatacccttaaagaagtggtcccattctatttgaaaaccatattcatacctgtagtttccagctgggacctacagatggagcctcacagttcgagtgttctgtgtgaagaacttttaaaatgttttgattttttttttttaatttaaatacattctggatctggaagacccagtactgacatgggatttaagggcccacttgggttcttgtattgacacttgtattggccccaaatgatcttctacagccttggcattttacttccaaagtcagcatcttaacttgggatcttggaatcccagttttgcagattatcaagtttgagaaacacggctctgtccagggcctctccccatagagtgcaggttcttcatagcacaagtgtgctgtgcatggccaccttgacaaattcatgcaaagtctctccctgttcaccgtggcttctactcttggggctgtgtttgcccagagagattcttttgtctaattctcacaaaagtattgtatgggttaacattagccttgggcatacactgttcccagattaactgttctaaaatgtaaccctattcataattctgtttgattgttccttgttcacatccgaattaagaacagacttctcattctaagcatgttgctctgaccttacctccagctccatccctactcgtattttgtgctttagccaagtccaagtgtactttctggtctctgtgttcctatgcgtggtcctctcaccatcaggaacttggtgcctttacccagctcagctaaacacagtattggagcttctgagccctgcctaccatacattatgttctgtgaggtatatccgtgcttctccccaccctagcatctgatgttatctctcctgggaggtagcatgatgtggttaaaggagcatatgccttggaaccaaaaatatctgagattgaccctccctaactaagcctttttccttcatctataaagcacaaaaacaaaagaaacaaaagccccactctgcatttgcagaactgttttgaggatttagtgtttggttcagtgcctgtcccagggagggtgctccaccaataagggtttccttccacttcttgctttgaaccccattatatctactcttatggactctttaatggtccttcctgtgctctgcttttatacctttttggaatttttgtcgtcttacccactggtctgaaagcataaaggctgcacctttttcctcctaatattcctgtagtgcctgccatgttttacatgtagtaagtgctcacaaacatctgctgaactaaattggattactgatcttctcagagcttcccagggctcttagattagtagactccttactagtctgtccatagatgaggtgaagagaactgagaggagtgagaggagaggacattgacctgtttggggaaactacggaatatttcccaaagttggtaacttcagtactggagagaaatactcaattggaaaagcctgtggagttctcttgtgttactttaaaaaaaatttttttttattattatactttaagttctgggatacatgtgcagaacatgcaggtttgttacataggtatacaagtgccatggtggtttgctgcacccatcaacccaccatctagattaggtatttctcctaatgctattcctcccctagttccccaccccctgacatgcctcggtgtatgttgttgttcccctccctgtgaccacatgttctcattgttcaactcctacttatgagtgggaacatgtgttgtttggtttctgttcctgttagtttgctgagaatgatggtttccagcttcatccatgtccctgcaaaggacatgaactcatcctttttttttatggctgcatagtattccatggtgtatatgtgccacattttctttatccagtctatcattgatggacatttgggttggttccaagtctttgctattgtgaacagtgccgcataaacatacaggtacatgtgcctttatagtagaatgatttataatcatataatgggattactgggtcaaatggtgttacttttaaaatcttttcctttatagcttgtttttgttcatttctaaagaaatgatgggtagttgtatttctttctgtgtttattttttactttctcatttcactcctgttgggtcagcatttagacgttaagtgtatgggatgcccataaggactttgcgcttttggaatggtctccatctgtgagggacactaaccagtgcaagttaccgataatccaaatcgttattgtggtcagtattatttattatacattactagtgtatttcacatctgcacttggcgaggcctcattcagctacagaaaataaattgttaccaccatttcctatttttgaatgtttttctctcaagctactctctatggaagacaccgcatgtcaccttgaagcatgcagaattttgaaaaagtttgtcacaaccaagaaaacagttttagacttcatataatgtttcttcttttaacctctgccattactagatccctagagactattcagaattcaaactgcagagtgactcattatgtacacagaagattgttcttcattgccctggtgcaaagacataaaagcacactaaactatctagttttattaattttcgctggaatagttcatgttagcctatggttgtaacattggttctgtgaaaattggaaagtgggaaaattgataattgagaagtaaaagtttcttaatatatcagtatgagtaagtttttccctgaaatttccccaggcagaaaaaaagtaattggagtggttgactaaactgtatcttccagagggctatgcacagtgagaagggtcattggtcataaacaatgggtgagagggccatttttaattttaattttatttttttatggagacagagtctccctgtgttgcccaagctggtctttaactcctgggctcaaacgatcctctcactcagcctcccaaattgctgggattacaggtgtgagccaccacgccaggcctaagagagatttttgagtattggctaggagcctttggagaaatgggcaggtgaaaaggaatttcagtatatcctggtttaactcatgtgccacctcttcaggacaacatacggtaaagattgtgctactcagcaaggtttctggaactgcatttgcatgttatctgattcctcagtgtcatattaggcctcaaagtggctctatattagggttgtagtagaaaaggtcttttaaaacttagattttggaaggaacaagagaaataatgaaaaggacacttgatgatagaaagattgagacccatagtaactctgaattttgccctgtaacaatcatctgaagactgagaagaaccaagacatacaaaggggaggaaaattagtaactagggaaaagtaatttcacagacttgaaagtttccagttttgcttgagttaggtatgagtttcgattttgaagagctttcattaacagaatttgttcataaaaatactttaagaaaacaccattagtacaagtaagcctggtatatgttgacagagctacacaagacaattttatttgcctttctactctttgtctaacttcataacaactatgtttgaccatgtgtcatagttgagaaacaacaggaacgaagaatgaatgtctctaattaacatcaagattattttctcttccacagttatgcaaacacactactctctgttaaactagaagttttatcccaagggcaagataacttaagctggaatgaaattcagaattgtattgatatggttaatgctcaaattcaagaagaaaatgaccgtaagtataagacactttccttctctagcatagtgggagaagaaggtatctggacaacttagttttctagattagggctttaagtttttgctcaaggaactttgtgagagcaaactccgctaatatgcatacctttatttataggtagattttatgcctataccactgtaccaatatgttataaacgttacaaagcctacacaagaattcataatataataaaatacacaagtaaaaggcctgatttttctggttatttgtacttcagagacagctaaatacagagacagctaaataactcatatttttaagcacccaattttattttgaccttttatttgggcatctttttttctgaaatatgacacgatttttctgccccacaaatggaggaattggaacacgatctaactgttgcttaatgatcacaaatcatggtgatttgctgtgtttctagaaattatgagctgccagcatgaaagcataccaacctcaggaagatatgccctgaaacatgctttcttgaatgtcagcttgctgctttatcatttgcatcttgcttatgaaaatagagtgaagaatgaggagctatgtagcttctgcagtccatacattcactgcttttctgtagtatgcattaccaaattcaagcttcgagctgtgttttccaccatgaaaacaaagcaacaccatcttctgtggcttatgagcttttgacttgtcagcaacagtgggtgagtgttgctaaaatcattgatctctcctccaccttccagctttgacttttctaactcatttgctccaagctcgcggatagagtgggcagatacttctctcacagtttattatgttttattttagtgtgtttgggtaaggtcttaggtctggtcttctaatgctgtatttaacttaggaatactaagatcactcttgaaataaaacatatgactttgttaattaattgcatttgcaaagttttcttctttttctttgctgtttcctgtgagtgctgggccaaaagtcaaggccagttttggttcttgttttttaaacatattctcactttaagcccctactataaaacaggatccaggtgtgctaccctatatacggtaccatggatgtaccactgttacactgatccctggacactttcattttgtccttttcaagttgtgcacaaatctaaatttctttcgagacggcacagcttccctgttgcctctgcatttcctttcagtgaagcatttaaagtctctgcggtgagacggcttgctcacaccccacttagctcttttctgatacttggcttgggagtttatggttcttgccagacgttagtcaagacgcaagctctaatttgagcagatgttcaacatcatcaggtgggggttgggggaccaccactgctcctagtgtcccgctacagagctcagtcccccaggcttctgcccttctccacaacctccgtcttaatgctctgaatctcctttagcagtggtttggttgctacagcaactgccacccaagaagtaggactcctttcttttggtaggcaaaacaaagactcacgtcccatctttgctttctaactttttccccaattcttggcaatacccatgcttcagttctgctttggttatttctgtatgtgctgcttacacaaatgaaggtatgttagttctcagtgctgaaagattgtagggttgacattgattaacagggggaaaatgccagttttgttcttggctatcaagtacagcctttgctttagttggttactggggggaaaaaaagcaagtaacatttgcataacttagaaaatagtcttttgtaagtagatattatttttaagcaaaaatctcatttgattgctgtggcttttatctatcaaggtaacagcactactaagttattctccctaggacatttcacacagccactataacacttctgttaagtatcttgtcataaaggacatataccataaccagaaaaggtatttcagacactaatatttcctttctggaatttgggaactttaatacagagtatttaatttatctgtgtcttggttttatttttttcttttgtcagaatgagttcctgaagtattgagtttgatatcatgtttaggcaattcttcaaaatctaaaatttctaaaatacaccattgtaaccaggcaggaattgctcagtatagtaattaagtcatctgaggagctgagaatttttcatggacgttttgaaggtgcattactcttgcctccccaccttattcttgccacatgctctgagatctaattccatatctgagttgtgatgtgggtgaggtaagcagctaatggaaaatgagaaatatagaaggtgaatttaatggagaagctagctgctgaatgcatttcctcaggctctgttgatttcttactgaaaagtttacttttcccagtagaaccataaaggagcattattttaaccttatagcctacatcaggaagttttcttctttgagtttttgctctttaaatttggtaggtacaattctgtgtaggttacctcatctgctgcctcaaatacatgaactctaaaagaacgcccactctcttgtggactagaatgttatagtaacatgtgttgatgtaaagaagtggaccgtgggctgagtgaagctcagcaatctttcttcaaataggatttcccttttatttataaacagaggaagtgatgcatatgttcccagagggcttctgggtaatctttcagctcctatgatgtcattcactatgacctcagcagcttgtattcttagaaacgcagcagacagcaactttagcaggtgatttcaatcaagtcagctgaaatgcactcacttccaggtgatcggccttggttctgttaagaccatttttggatggggtgttttaaaggtatttagaacagcttacccaaggggggtgaccagagaatggcactaaatattccatgcactccagtttataaatcctatagggtaaaacgacagtaccttgtatatagataatacttagactttccagagttctgtcaatgtttacagataatataacctgcacattagagaaatacttctgctttttcttcaaacatatttaagtattatagtctggaatgatttctaggagttttagatggtttcattcttcttacaggtaaatcttttcattcttaacgaagtggtggttatgggctcatctattcaagaaatatttagctaaatattttatctttacttgaatgtcaagctggagatactttttttaaaaatgagaagtactcattctatttcatggcatatcacagttgtgaagtgacgggtgatcattttagattaaatctaatggaaaaaatgagaaatatgaagtttgaccttaaaaatgcttatattctaagcttattgttcattaatatctagtttctttaacagttcttatccatcagtactaacctaggaagcaaaagctccttggcagtgtgtgtatatgtgtgttttatatatatatgtgtgtgtgtgtgtgtgtgtgtgtctgtgtgtgcatgtctatctaaatgcatttttttatgaatggatgatagtttattttttaataataaggtattgagaagtaacctccagatagatccgtttcattagaattgtaaaagcaggtttcatagtttgacttctgtgcttttcatttgtgaaccctatagtcagtcttgttctctctttctctctctctctctctctctctctctatatatatatatatatatatatatatatatatatatatttttttttttttttttttttttttttttggtggggggaacagagtcttactctgtcacccaggctagagtgcagtggtgcaatcttggctcactgcaacctctgcctcctggattcaagtgattctcctacctcagcctcccaagtagctgggacttgaatagacacttcatttctttaaagatgatgtacaaagggaaaataaacacatgaaaagatgctcaaaatcattagtcactagaaaaatacaaatccaaaccacagtatgataccacttcacacccactaggatggctgtaatgaaaaagacaataacaagtgttggtcagaatgtagagagctactcaggaggctgaggcacaagaatcacttgaacacaggaggcggaggtggcagtgagccaagatcatgccacagcactccagcctgggggacagagcaagaatctctcaaaaaaaaaaaataaaaataaaaaccagcagctgggaccttgatagaagttgcattgaatctgtaggtcaatttaagaagtatttccatcttaacaatactaaatcttccaattcatgaacattggctcttttcatttatttgtctttaagttttttcccatggtgttgtatagttttcagtgtacatgtcttatgtttctttcattaaattatgtctaaatatttatttataattataatgtatttgtagttgcagtcttatgaattgaatgtgttcttaattttattttcagattgcttattatgagcgtatagacacataattggttttgtgcttgcatcttgcatcctatagccttgctgtactagttaattagccttttgcaatcggtgatactaaagaagttataatgtactgtgacttaaaaggaaaactacttcttcattttctaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagtaagttttagtatatctgtttcttttaaattttacaggctgggtggcagagggagagaaggaggaggatttgacccatttacgttaaatctcatgagcttcttgtcccaacaattacccatgaatcagaatggaaataatagagctgttattttcctggtaacaaacattggggggaaaccagctccagagctatttattgctttaattctttgactaaaaactcagttgtaggtgagttcttgttcagagttcaattcattgactatttccttagtagatactatgtgcacacttcagtccatagcttctggtagagaagatggggatacagagggacacataataccatttgaatgttctctgaccttatcttcaaaatgcttagaaactgattgaggcagtggacattgtcacatggaacagtcaagtaatagtaaagataagggtgtgcaaagtgtcaaaatgagagatacacagattgattcacggatgtttgagattgtcggggactagaatcctaagagaagttggtgtggaggtagagcagaagctgtcctctcgaagactagtggctttttctgagtacagagcttgtaccgctattataaggagccccacaaagactggcctctgtgataaggccaatgggctgagtggtgaggctgatatgatctgtcacctaagagtgggagtgatgccacctgggacctagctacttatggctgccatgtcttcaggtgcaaacccaactgaaagggcggtcatctcctctgtctaggtctttagaacctaggaactgcctcattcgaaacaggaaaaacatccttggttaatgcaaacatttattgagaacctactatttgtcaggcatgatattagatactcatgtgtatcatctcatttaatcatcacaacaattcataacagccttctgaaccattttgccatcattattgccatcttacacataatgaaaccaagattaagtaacttgttgaaagctatctaaaatgtgaccgggcacagtagctcacacctgtaatcccagcatttcgggaggccaaggcaggtggatcacttgaggccaggagttcgagaccagcctggcaaacatggtgaaaccccatctctgctaaaagataaaaataaaaaataaaaaattagccaggtgtggtggctcacacctataatcccagctacttgggaggttgagggacaagaatctcttgaaccgagaggtagaggttgcagcgagctgagatcgcaccattgcacccccacctgggtgacagagcaaggctctgtctcgaaaataaatacataaaataaaataaaacaaaatcaagctatctaaaagataattagtcctgagactacatgcagctcaggtctgtctgattcggaaacattataattatgtattaaggcagatgggaaaagatgtttattgcagctttgtttgcaatcacaaaacatgaaaaacaacctaaatgttgttaagcaaaaaaaaaatcatgctgtgatgtgcacatagatggaatatagataggcttgtgtatgtgttgggggaggggcgcacacactcttacatgtgtctaaaatatttctggagggaggataccttctggaaggtgaactagaaggctagtatggatgggagatttattcttcactccgtttttgtactgcttggatttttaaattttttaaggagtgtgtgtattaaataattactgtttctaaacttttaaaaaccaatgtaaatcctatcctcactactccactgcctcattgaaggtggagaaatgtatcccccatggtggcgccctctgcactgccagccttccaacaggaacggcagtggcattgcctgaccctcctcactttgccaagcgcccccactcacatcagtctttctcatttaagcctcataccacctgtggaatgggtgctgtctcatctgatgtgaacgagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaagatagacatcattcaaatcctggctttgccacaaattagttatgtgatcttggtcaaatcatcaaatctctatatgcttatttttgcatgtataaaattggaataatagtacctgtcttataggattatggtgagggttcaatgagaatatacaatatgtaaatatatatcaatatataactataggtactattaatgaagaatatgtgcacgtgtttgtgtagctatagcatttagcatggagcctggcaccaaaaaaagggcttaaataatgtagctagtattattgtgggcacctatggttgcctcccaagtaaggggcgagtgatgtcagtatcttaaggttcttttttttgtgaggtggagtctcgctcagttacccaggctggagtgccgtggcgccatatcagctcacggaaacctccacctcccaggttcaaccgattctcctgcctcagcctcccgagtagcagggactacaggcacctgccatcaagcccggctaatttttgtattttgtagagacgaggtttcaccatgttttccaggctggtcttgaactcctgacctcaggttatccacctgcctcggcctcccaaagtgctgggattacaggcatgagccaccgcacccggcttcaaggttcttactagacgtagagtctgctgaatttacacaccaaagtcaggatcttctgaggacaaatagagacagacctgggtccctgtctgcccacagccacatgggggtttgtctttgaggtgagcctgactccacaaacccaaggcctttcataggcaggcagtataggtcccttctagactgagcattccaatctagattgagatggaactccacaggcgtcctttgaaagaagcccctgagtgcccacaccatgccagctctgtgtcaggcatcctttctaggtgtggaaacagtagctttcatggtgtgattagagcattgatatggagcctagggatctgggttctagttcaggcgttaaaccactgttagactatagttagaggtttgaaatatactggcaattactaacagatttaaacagatttaaaatactgcaggtccaagcgatgaatcatatttggttaaattcctgtttttaagcagttttctttctctgttcattgactttgaaactttcttttctcagcctgttcttttttcttggaaaaatcctaattctgttgtttggcaatgtctttaatgtctttgtttttcccctctgctttttttttttttttttttttttttttggagacaggatcttgctgtgttgcccaggctggtctcaaactcctgggctcaagtgatcctcccacctcagcctctcaagtagctgggattgtaggcacaagccaccacattcagcatcctctactattttgattcctagaagtttccagttgtgtgtttatgatggtatttctgtgccttgtcttcccaaggtctggccttggaaaataatattagaaaattatattgctggtattatcagtataaagtaaaactgtgccaaaggctacagccattaaaggtcacaatgggtaacatcttcatagaatggctgcccagttttgtcaaaggtggaggacagtaatggaagttggtgaagattctgggtcctctttagcagtatgtcaagtataaccttgtgtagctacaaaattccttttgcctcttggaaagagacttgagtaatggtcatgttgactttaacactttttctatgtctgttcactgggtggtgtgtgctattttacaattgaaggttttgcttgtgaacatatgagttatactccaccaaaaagttctgttttgctccttgtatataccataaaaactgtgtgcttttaacgaatattgctgtattttttccttaggtaaaactgtgttgtaattgatgacttagttttcagaagtcagctccttccatttaagtttctatcttcttgaaacttactttaggtttgtttttcattctcactttagtgtttacctgagttttgctctttgcataaccacacacatattataaagggtcttcatgtggaagctttttacttaagtctgatgaaatagaaaactgtgtacatttaaaaatatgcatttaaaattgttttttattgttttgttgggcagtatgaaatatacagtcaaggcagattcgtacagacttgtaaagtcatctcaggaatcttttatgcttaaagtttcctcagccccatttatattcactactatcattcactctttaccactaatatcttccctgctgtctaatcactaatatcttccctcctgtctaatcactaatgtcttccttcctgtctaatcactgagttaagggaaaaatagtcatttacttacaggaatataatgggtattaataacaaaattccatttccccattaaaagctatgtctaagaaaaaaaatagtggaggcattatttaaaacttctaaatggcctggtgagtatagtcttagtttagcttccttacttttttgtatgcccaacctgaaatgatgtcatcccgtatcatcacagtatgttgctttttcagtacgaagttaatgggctttcctgctgtttaactgctttgagattttaaaaattcattcagccacatagtattcaaagcatggagctgggtgccacaaagacttgggcctggcatcacccagaagctcaaggaaggcagaggatgagcaccttctccattatacttggtacttgattgttcatggaattaaaatttaaatataaatgaactatatataaatgccataataaaaatatacgaaagtgctttggaagtacagataagaaaagtgacacttctagcctgagaatcagggaagaatggtccttcaaggacttgaaaaaatgaacagaattaaggcaaagacgttaggactagcttttcagtctgaggcagagtggagatatagcagagcaagaggtttggttggtgcctatatcataagcaaggtttaatgggaagtgtgattagcaagttagccttgaatgccaggctaaagatttatgatttattatagaaacagtggagttagtggaaatgttttagtgatgtatcctaactgatatctaaggaagattaatctggcaggacttgtgaagtggtggagggtaggctggcagtggagagaatggttagaaggtagaggtggcctggacgtagtggctcatgcctgtagtcccagcactttgggaggctgagataggaagatcactcgagaccaggagttcaagaccagcctgggcaacagtgagactccatctctgcaaaaaataaaaaataaaattagttgggtatggtggtgcatgcctgtagtcttagttacttgggaggctgagacagcaggattgcttgagcccaggagttggaggctgaagtgagctatgatcaggctactgcacttcagccaggtgacgaagcgagacactgtctctattaaaaaaaggaaaaaagaaggcaaaggtgaaactagataaaagaccctggtgagggaccctacaaagatagaatcagttgatgaggcagccaccagcatgagagtcaaaagagaccaaagaataaaaaatgatgtcaaatgtcaaggatggcaataccactcacagaaatagggaagatggtgatttaaagagcttgaagtagcaataaggcaaatggaaatgtcattttccatagagttgtgatatcttttctcctgcattaacatttttaaaatactgataaagtgtttttaaaaattactaatgctggctggctcagtggctcacgcctgtaatccagcactttgggaggctgaggccggaagatcacttgaggtcaggagttcaagaccagcctggtcaacatggtgaaaccccgtctctactaaaaatacaagtatttttagtagctgggcatggtggtgtaatcccagctacttgggaggctgacctgggaggcagaggttgcaatgagccaagatagtgccactgcacgccagtctgggtgataaagtgagactcagtctcaaaaacaaacaaacaaactactaatgcttttgtaatgtttgacctttgaagcatatttcttaggagctcggaaatggagctccttgcactatgcttatgttgttcttgaaaacagacgttctctgtgatggctgtccttgttctctaagatcatttcactattttgtaaggtaagcagtggagtgatttctggtttttgacatgagaaaataaaggaatggatctaagcaactattaagactacccaggcacaaagctatgagatatataaaatataagccatcagtgttgttgtagtagtagttagcatggtgaataataagaataatattgcttggagcaaagcaaatggtaaaaatcacaaggatgaggagactcgccttaacataccacaaccatctatgatcgtatgcattaagtgtccggatgatggctgcatagcagtagatgataagcacaaatggaattaagaatccaaagaatgccaaggagatgaagtaatagagttggaagggagatgaggactcgcaagtgttgtgaacatcatggcaggtggtgatgtctggctgaacaagataatattcctgcttcagtatgaaaaatggcagcatatataagaaaactgttgcccacaccagtccacatgttaccaaggcataggtgtgcttgggcaggccccggtaggtgaaaggatggacgatggccaggtagcggttgatgctgatgcaggcaaggagcagaatggagcagtacatgttgccatagaagatgactgtggtggcccggcacaggacctctccaaatacccagttgttcccattgagatgataagctatcttaaagggcaatgtaacacaaaaaagaaaatctgcaatggccaggttggtgtagaatacagtggtacagatggatctggtcctgaagaaaagcatccacagggtcacagcattggccgggacaccaactacaaacaccaggaggtagatggcaggtatcagtttagtacttaaggagctggtcaggtaccccatggtagcatttttcacatggagatgtgaagcactttcttcagggcacttaatttttacagtaatcgtggctcctgtccagccttccaaggcagaaaaggggaactcttcaaaagaatttgggggagctccacgaaaggtcttaatgggtaaggttggctttgccaagttgtttgtatcattttccatgcctgtaattgaaagaaagtattaacataaatgtatagttcaagagaaaagaaagtgtgtttaattatttgtaaataatttctgtgattgtagaatttaagatcatttttattttaaaaagttattgtagattaggcagtcaacaagcatatatttaatacatatcatatgccccagaacaacactatcttgtgcggaaacaaaaactaaatgatcagtccttgtatgtaaagtgtttataatactattagaagaaacaaaaacagcccatcagaacattataggcatgttgactacaaactatacaggcattcagacaatacttaatagattcagatgtttgagcaaaatgtcaaggaaaagatgaacttgagcaaagactagcaaggttcctaaaaagatggaatttaatgagtaagattctgctggtgatgaatggacagaagcatagtgtgggctatcatgggatctgggaatgccagataagttgatttagcaaatttttattgtacattgatgtgtcagtggtgtaaagttttaaataaaatccatttctatctgtaagtaatgctactcgtggagaagatgcataaaaatgcattgtcttatgcgaataaagtgcagctgagaaaggaaattgaaagagtgggtgacagctaaattcctgaagggcctctaaactgtcctaagaaatcatatgtctattcacagatgatgggattgcacacacaattttgaacagaggaatgaccattgtgttaggcagaatagtagccccccgcaaagattctacctgctaattcctggaacctacaagtatattcctttacctagcaaaagggattttgcagatctaacttagttaaggatcttcttttttttttttttttttttttgagacagtctcactctgtcgcccaggctggagtgcagtggcacgatctcagctcactgcaacctccgcctcccgggttcacgccattctcctgcctcagcctccccagtagctgggactacaagcgcccgccaccaggcctggctaattttttgtatttttttagtagagacagggtttcaccatgttagccaggatggtctcgatctcctgacctcgtgatctgcccgcctcggccacccaaagtgctgggattacaggcgtgagccaccgcgcccggccagttaaggatcttaaaatgagattttcctggattgcctgggtgggtcaaatataatcataacagtccatataaggggaaggtaagagggttgtcaaagtcagagatttgaagatgctatgctgctggctttgaagatggaagaaagggtcataacccaaggaatgcaggcagattctagaagctgaaaaaagcaagatagccgattctctcctagagcctcgagaatgaacacaaccccaccaacagccttgattttaagacctctgatctccagaaatataatctgttattttaagccactcagtttgtaatgatttgatatagcagcagtaggaaacgaatatagccgttattttgacttgtttttaagatgacttaggtaatagtgtagagaacagattggaaaggtaagaaattacaggcaaggggacctgatttggaggctactgtcatcattcatagctcagtgagttactgagctagaacagtggttatggaaaggcagaggcgaacacgtgagactctgatggcggcttaaagggacttggttctgattggctttggggtgcagtgagggagaggcaggaagcaataatgactcaggtttctactctagatgacttggagggagaggatgccattaactgagttggagggagacaaggagacaggatcggggagaagctacaatctgtttttagtctgactgaggatgagttgctggtggaatattagtgtgtaaaatgtccagcaactggttagaagactggatgtgggtccaaaattccaggagcccaaattagaggcatgatttattgtagtctgcatggaggctctcgtttaatttaatgggagtggttgagatggcctagggggagttatgagaagaaagaatccaaaggtggactttaggggtaatgacagattttaagggaagaggaaacaaaggaggaaaaatcggaagatgaaatcggtatgaggacctaagaagttggaaatgaattctttaaaagatagaaacacatcaactatatgctatcaatatttggtgttacttggcatgttgatgttaataatcctaattcctgcaatttcaaaaacaaaatcttaaagctcaaacctgaacatttattattatataactttttgtaaccctttcacatgtatagaaaatagattctcccagatttctaatgttacctttaagatagacttctatgccaaatataaacctcattcttatcgatttaaaatgccagtactgcgccattatgtcttgtcccatggcctcaaaattcctccatattgaatacttgaagttagtgtttagtaacctatgtttcattcagagccagtttctcttcctgctttaatctctagcagttagctcccgggtgaaatggaaaccctccacgtaaacctgagattgcacaagctgaattcacggtgtaaaatagaggaggtgtgtcctagtaactgaggggtatggaggtgatcaggtatcatttaagaaaaggtagattaaagaaaaggaaagaaaaatttgggaggcagcattcttctatgcctgtatttagaggtgatcttagaagctgtgttgtgtgacacacaaacccttctgctcacttttgcattttggaaaagttcttgcatctgacatcacccaaagagaagtgcctttaaagataggcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgttaaatttttttattgtattttaattctttatagaggcttccattgggcataatatttcggaaatgtttttctatccgggaaaaggccttgaagaactaatccaaagagaatgaactccggcctctcaggggtgtccaagggagagaatacagtcatggattcatagtttctgtttctagttgagccagtaaagccccttcctcatccctcttttccatttacctctagagacagaaactaaaaaccatggcttcaggctgctaaaagcctaaaacaaaacaaaaccacaacgaaataaggcaggttggacaagcttgcttcattcttccttcacatttctcccccaccccatggaagaaagcaaattcactgcctctttgtttccttcagaggcccccgttttcacctccatcaaaccctattagcgtcttgaaggaaccacccccgaaaaccttgcttcttttgcaattctgcttctcaacatattggcccatctactcccagaaagagcgtgcacttattatattcataaatcccacatgtgcttactgctaatcaccacagattctcttagagctctctgcaaccgctcagggattccaaatgtgaatttaagcaatgttcctttagaaagcattgatttctgtttttgtttcccttgctatgtccagtctttgcctctcccactcctaacaatgttgactggagtgtgtgacctaacaaagagtaacaggtacagacctatcccaaatttgttatttttggaaaaagcaggaggtttcaggctaacattgtgatgggtaaagtggaaagtacattcaaagttgaataatagtatttgggagaccttatttttaaaattaaaaaatcatatatgagggtagggagaactccccacttaaagtcaaaaaaggtcattcatttcggaaatactgacttattagcattgccagctattgaaagcagatgactttctctttctggcagtattcttgtttctcccatttatgtctcaccaagaggtttaaacacaggatatatattttaatccctagaaaaagtgccatctttgcttaaccagaagagaaattcttacaaacacaaaaacgactttcaaaattgctccctgacttaatcgtagacatctaaaatcttgaatatgccacacatttttaaacatcaggagggaacacttagtctatgaccaggtttgaatagagtgaatgaactatagatgttcatttccatgattctaccttttaataataaagatcaaactgcctttggggtttacagtttgtgtgagatgcaaagaaacctaggttcagttgactcttaatttgtaacagaaacccacatccccatcctaccccctgagaaaattgcttaccactctgacaaaaagtgggcaacagaagcaggaggccagcagctgcaaagatgagggctttcattttgatgacctgagtcccgtctcttaaacgttatgaaatctgtaaaatcatggagcacaatttcacctcagttccatgtgtcagcagcaaatggaagccttggtctgtctgtagaagtttgctctcctgtgccgtgcaggcaggaaacttgccctggtcctccgcagggaaaggatgtaatccactcgatgcttcagtaagcatgactcaggccaagcctctgaacgtgttacgttatccctggagaaaggcatttaactcttacccacccccaacaatctattctgaataggtgctgtaattctcccctagtagatttgcttttaaagaatggcagaaattacacaggcctttacagaactaagccaaaaacagatgttgaacagcagtaagttttgaatctgtcccacatttcatttcttatccgttttaaaaatgcagttccagagtgtaatttctacttaataaattatcctttcctttatcttcccagctatttcaaatcttaatccttaaacactttacataattataaattaatcatggaaaacaaacttttaagaaattcaaattgagcggtgaatcactttgaaaattttccatcaatgtaatattgatttcagtttgtcgtcagtgcctggccagaacctggcttttgagtggtggtggtttttcttcgccgggtgaggatggcgtttgttcaggcttttttttttttttttgccttatcttgatgtgttttgagccattcaataacccttagggtcagataactggaggaacctcccaaacaacgctgttcagttaaactaaaatcatagcacatcatgaaaatgaggactccctttattccatgagtgttggtgaataagtctacaataagatatttttaatagtggtaaaatatacgtaacataaaatttactatcttaaccagtattaagtgtacagttcagtaatgttaaatacattcacattgttgtacaacatataagcttttatgaattgttatattctgtagagtatgacttaatatacagtaaaaaaatgcattataacacatttttctgtagttaataaaacttaaacttgaagcctgaccatcccacagcctgctctttacaaaatgcagcaagaatcagaaaatacaaatttcacatgagacttaaaggctagggatatgctaggaagaaattgatctgcggaaacctttcacatcttgattaaattacattagaccaagatttttacaaaggtcagtgtttaatacttcaactacataatatatggttatacaaactgagatagaatgttattatattgcagaaatataaaacctaaaatattgacaaaggttttttttgtttcattagaacttttctgggagttatctaaattcaggaatttatgacttgatttgcacatggcctagtttctggtcatttaattcatttgtaactcttatgttgaacctggctgtttaactgaagtggaggtgtggccgtcccataaatatactattattttcagtcttctggtgaacaactgaaaaagcagacttggctgggcacagtggctcatgcctgtaatcccagcactttgtaaggctgaggtggggggatcacttgaggtcaggagtttgagaccagcctgaccaacatggtgaaaccccatctctactaaaaatgcaaaaattagctgagcgtggtggcgggcgcctgttatcccagctacttgggaggctgaggcaggagaatagcttgaccctgagaggcggaggttgcagtgagcaagcctgggtgacagagcaacactccatctcaaaaataaaataaataagaaaaagcagactttacattgataagattcagcttttacttttggttttacatttaactctagtaatcgttagttcaatgtttcataatttaaaccgttgacttaaattcatctgatttgtaatttctctcttcagtttggcctataagactaatactttaagctttgaagtaagattgttactgccttctcatctgggtagaaatctgtgtggtgtatcttctacagtgataagttatgaaggaaggcaaatacccttcaaaagaactgagacacataaatgaactcatagagcttagtttttaggttatagctggggagtgttgggttctcttagatcttgtaaacagagaaaaattagctcctgcttccctgtctctttttttcctcctctagtcttcccctttccacccggcttcctgtttgagcctcccccatccattcttgaaagaaatggaaaatcttgctgatgcttcccttgtagtctgccgcatagctagaggtgattgtggaagcaggcaccaacacttccccagaggtctcctttagcccagatgttgcacgatgaaataacagatagtttatctcattttcagagccctttccacatgcattatctcacgttaacctctgaggaaaatagtgttagaagcctgccagaggaaccagtgactatttcctctccttcctgcccccatccatcttaagttttaaatgacggagtcggtgccagatccattacctttcattcatcacagtcttgacttaggatttagaacacgacacttattcctacacataggtaaaatgttcccatttgttaaatgtcacatgtttcctgaaaatatctctgctgataattatttacttgccatctcagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaacttgacacctttaccataggttaaccctttctcacctatgtctggatcatgtgtctgcagtatatattgccctgatcacattgtattataattctttttcttttttttcttcttttctttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagtagagatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgacgatccctgtgtttctctcaaattaaaaatatcccatggtaccctgggacaccttgacacttagtttgggaaccacaataattgattgagggagagagtgtttgactagggtagcccgggaagactttttggagtaggtagcatttgagttgagacctgaatggtaagaaaaagccaacagccacacagtgagggtagagtattgtggtctgaaagagactcgtgtgaaggtctagaacaggaagggggaagtaaacgggtgtgaggtgcagccagagaggcagtaggcagggccatgccgttggagccccgccatccctgagaaggcaccctgtgtttccttctaactgccgggggaagcctttggggaagctttaagtagaggagtggtgcactgagctatctattttgaagggatcctctgggccctctgtagagggccactgtggtgagggcaagcttagatgcagcagaagctgctagggggctgatgcagctgtccagttgggagatgatggggggctggactaaagagtggtggggaagaaggaggaagtggtcgggtttggggtctgcttcattaggagtgtgtacagtatatggcagagctggatagttgctgattaagaatttgtgggaattatgattaaatggctcctcaaaagcagttattaattctgtttcctcatcattcactcttctttctttttattctgtgacattgtccccaggactctgagagtgtttccaaagtgctttggctggatgagatacagcaagccgtcgatgatgccaacgtggacaaggacagagcaaaacaatgtaagccctcacctcctttgctcttgaaacttgcctttttggatttggttatgtgcctgaagtcatgtgatttttaatttctgaaagatttggattcttaccaagttttagttcttggacacataattataccgaaattagttggttgccctattgtcagtgatttgactctatctccaacaaaatgtaacaatgttgctgaacaaaatccagaaggtaaaaaatagtttttaagctctcaaattgtataattgaataaaattctttttttctcttgatttttagagaactagaccatttctacttaataaatgcctttttctcctttccatggcctttatagttaccagggttttccacagaaacagaaccaataggagacctatggagttggctagctgatcatggtgcaactagaagtgaaatagactggcagtctactcaattcttacttaatctgtacaactggatgagttttgggtcaagcaaacagaagtctaccttgaatcataaaaatagtcatggaccctcaatcagttcccagaatggggccagtttacaaacccagaacccctcaaatgaagggaaggccaggccccttgaggaaaaactcagctacactaccaaaaatttatactgttagtctttcttccacccctcccccaaagggacctatggccttttaccagggtgactgtacttaggagaaagtacataatcagacttttgggaattagtggacacttgctctgaactgacactaattccaagaggcccaaaacataactgtggtccaccagtcaatgtaggggtttgtggaggtcaggtgatgaatagaatattagctcagatccatctcacagtgggtccctaaactctttctgtggttacttccccacttctggagtgcataatcggaataggcataatcagcaactggcagaatccccacattggttcaaatgataaaattgtttaaccctctgtttttaaggaagaataacatgaaaattcacatgatagtctgaaatagcttctaaattgctatactaacattctccatatataaattaagattcctaaaaatatatttcactaacctgccaactgatggcataattagaatctattctgttgtatcaggtcagagaaggttcttaagatgactttgtcttactccacagatgggcttttcaacctcggaagcatctgtgagaaacatctgggctttatctccttagcttagaaaaatgtgtgtatttctctaacctgaacttttattccctaaggaactttgaagtctttcctttctagcacgccttaagaaaaaaataatgaagtggaggtgtgtatataagaaatttcaacttaaatataaaactgaaggaagccatggtctgaagagacagttttgagaaagtagattgtaatttagacattcaaatagcctaagatggttatgatttgtctcttagaaatcaaaccaatttagaaggtttttaaaatgttcttatattcattgttcttacattcggcctgcaaatgtcaagttgattctgtttttcacattgagactcatggttctattgactataaaagtaagaggatttctcaaatgtataattttgtactctgtattgcacatctaaaatcctatcttttcactctgtcctgtcccttaaagagccgatatactttcttttactatatcttaaacagcaaaaaagattttccaaagttaatgctacctatgagaattttctgactttcaacaagaatttgattaaaaacattcttcattatttgcatgaagacttgaaatagattctggtcacacactataagcatcacacacactctcagataatatgataaaagaaaatgtgttggcccaaatatgttaccaccagcaaaatttaaaagggcagagtaactcaagtccctttcattttggcctagtgttcacattcactggagtatcttgcttgcttaaagtagatttgcctctacttttgattccttagagcagtctttctctacctttttctcattatggcaccctaaggaatctttttagacagttttttctctaatcactccttaccatgaaattttaatgccacagatattttgtatacctgtttatgtgccatatgtagacctgtactttatacataaagagatttttttcactccctccctgcaggaactaatttttgccccgttaggggttctatcacctccactgtgaatgtgtgccttaagagagcctgctggtatatggcttaagatgtaaagcaaacattttttggatctcttaggagatttatggaggtttcttaatttgttccttggcagaaacatacctgactttctggagtgaaagtcatctatctgatatcttcaactatctggaacttagctacaactcacagattaagaaaaaaagcaatcaaaatagatatctcaaagcaagcgcattgaagttaatctactttattcactgagcacccctcagatagacactttgagcctgttgattcttttcttaggcaaaactctattatcttggtagtttcttttcctggttggttgtgacttagagcacatcagaagccacaagtcacaaggcagtaaagtgcttaagctgccataggcaggcacaccaatgtcagtaaaaagtgacagctgacagtgaaggaagaaggaaaaactaagaagcataggagttattaaggctatttcgtgcaggagccagtaagcccaaacacctccacagtccttgaaaataacactcaccagattatagcacagcacaattttaatgacaaggactcttctggcagctctcagcagacattaagcacctactttataccatagactttgggtaaaataaggagcaatagcagctgtcctgttaggattttctctaaggcatgttttagagttccatcgaaaatggttctattaagatgagagttgatccataaaggaattagcttcagttatctggaaattgacctgtgaaccagctcatcgatactcaatgatgatatatccaagaaatgtgtgccttttgtaatatcttttaaggaaaattgcattttattgggttagatgacactgtcacatgtagttcatgtgataatttttgtcattttcttgttcctattacttttcttggaccacaaacttctcaattgccagtactcttattttctctatcctacaaagctttcctggagaagaggaaagggctatgtctacccatgttctattaacctctgttagcataagaacatgctgccataccttttgttcaacaaccactggagtttgcctgagaagttctccccttcatctatatgtgcccctccagatttgcatgactttgactccaggttgttgaaagtcaatctctgtttttctttctcctttaaccctcatagtgctatgcacatgtgaacataatttgatgacaacgaattgtaatttaatatttgtagagtttgatgtacgtgtaagaaaaaaagagaaagcatccgtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaggtgggaaataattcactaagttaactttccttaggcaaccaagagtttaatgtgttttgttaatgaggaggggtagaaatttgcaatgggataaaatgcttgttaggtctaaaatggttccagaattaagttttaggactccgttgcacatatccaccagctctgcctttctagaacacttgtttaggttgtttttgacaatcttgctaaatatattagcactatacaagagaataccaggatttctgtaacttaaaaaggattttgcttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgcattcctaaaacgttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtggtattatattttcttaattttaagacaagtaatgctttcaaattaacatttctgtaattttttgtcatctatggctaaggaaattaggaaaagttttagatgtttctttttagttttagaaagctatgatgagctcagtggcaatatatggatggcattaagaaaatgtcatatttgaggagtctgtgccttatacaggtcatgcttattgattcatttattcgtgtgagtagaccagtgatataaacagatgtttacactaatattttctctcacctaatcctttgtgattgcacagtattaagtaggggtaaagagtaattctgaatatatgaaataaagtacaatgagccagcctgcaagggatcagttggcaaagctaggcaactagttatgcctactcaatccaatggcagagcctacattgttagctctggaaagaatctttgagactacacagtttgatactcatttttcagatttggaagttcacattggtaagatttcagacagagggaaagaatggtagacccaaggacaattaatttttattccagaattcctttagtagatttttattaagcacctactatttcctagtgtcaaggatcaaggtggctgtcaacttctaggctagtatttatttgtaccacattgtaggtcatctacaggatactattcatctttaagaaactagtgtgacagtgtgtggccttagaagtagagcttaaggaaaaaaaaaaacttttttagtccaacttgatgtttgtctagtagtactctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattgggaaagaattgcataattgtataaatgagctatcctaatttcaaattcatcctggaaaaaacttagttcatcttctgtctcctaaacttgctatgtcgtttcccacatgtcatatttgggtgactatagtcaaatccctgtgtatccaattcagaaacctaggaagtgctttagattcattcttctgggaagaaaaaaatggcagcaagacttttgtcagctgagatcatattgaatctgtaggtaaatttgagaagtcttgccatcttaacaatattctgatccatgtacatgggtatctttccttttaatcaagtttaaaactctttcaacaattttttgtagttttctgcatataaggcttgcatttgtttcattaaatttattcctaagtattttatcatttttattttattgtaaatattgttttttaattatattttgggattgtttattgctagtttatagatatacgattgactttttattgagaaataatttatatgccataaaattgtccttttaaggtatgtaattaagaggtttttagtatattcacaaggttgtacatccaacacctctagttaattccagaacattttcatcacaccaaaacaaaacccaatacttattagcagtaaatccccatcacccactccccagctccaggcaactactaatctactttctgtctttggcctattttggacatttcatgtaaacagaattatacaatacatagccttttgtgcctggcttcttttacctagcataatattttcagagttcattcatgtagcattagtcagttcgtccttttttgtggctaatattccattgtatgaatatgccacattttgtttacccagccatcaactgatggaacctgtattctgcgccaccccctccccccaacttttggctattctaaatgagactgctatgaatattcatgtccaggttttttcatggatatatcttttcgtacaactgatttttgtatattgatcttgtatcctacaaccttgctgaactcattctaatcatttttagtaaatttcttgtgctgccatccgccttaataaataaagtttcactgaaatccagccacacattaatttatatatggtctatggctgctttcctgctgcagtggtagtgctgagtggttgtttcagagacccatagcctgcaaaactgaaaatatttgccttttttttttttcttttcgagatgaagtctcactctgtcacccaggctggagtgcagcagggcaatcttggctcactgcaacctcagcctcctgggttcaagcaattctgcctcagcctcccgagtagctggcattacagttacctgccaacatgcctggctcatttttgtattttttagtagagacggggtttcaccatgttgaccaggttggtctcgaactcctgacctcaagtgattcacctgcctcggcctcccaaagtgctgagattacaggcatgagccactgcacccagcccctactctctgactctacggaaaacgtttgccaacccctgttctagaaagaagagcatcccaagcaattaaagactgattctcacctccagatagagctatgagcattgttttcaggcacgcacaggatgatttattcttatctctttcacctctggttctaggatgtcttatcttttcccaaactgaaacatctaccatttggtggatggattactcagccttgtaactcagtttaacgcttctatatgttcgcgtataattttgtctgcaaggcatctaaaaagtatgcctccttgtggaatgttcatcacctcttaactaactgtaatcagtcttttttctaagtaacaaaccaactgtatttcttaggaaaactatttggagcccatgctggaaagtagctctcctcagcctctgatctaactacattcaaactagatgtgaaaaatgtaggaattctactttcctattacctactgacatcctaacccaagtaaagccttctaatgccattcagatctcttcatcaggaattactgtaatgtcccctgtctcatccttcattgggaaagaattacataattgtattaatgagctatcctaatttcatattcatcctggaaaaaacttagtttatcttctctctcctaaacttgcctgcttcttttcccacgtgtcatatttggatgagagctaaaaacaacagaaaaatataagaagttctaacttagactaagctaagtcagctgctatcaagtgagctttagactcattgcctttccatgtaaatcaaagttcaagtgaattgaccattggtgattgtcttttaaccaactaacaaattttttacttctcagttcaagtgacgggagaaacattttcaccagctttgcttgctttctttccttcccactgagacagttgccttaagaagggtgattattcttctgaaaacatttatgaatctgacaactattggtaattgaaaatatcataattggctggttgtggtggttcatgcctataatcccagcactttgggcggctgaggtgagcggattgcttgaccccaggagtttgaaaacagcctggacaacatggcaaaacccatctctacaaaaaaatacaaaaaattagccaggtgttgcatgatcctgtggtcccagctactctggaggctcatctgagcctggggaggttgaggctgcagtgagccttggtcacaccactgttctccagcctgggtgacagagtgagaccctgtctcaaaagcaagaaagaaaggaaggaagggaggggagaggagggtagggggagggaaaggaaggaagaaagaataataattacttgtaaacatcctaacttgactgtacaatgtattttctagtagaccaatgtttctaaacagatgaaccagctgtctggctgcccattgaaaagagatacatctctcttcctgggcattgacaaacagaaagaacaggtgaggggcatttaaagccaaatgaagcatcaacacatattaaagagccttaaagttacccctgcttagttatttacatgcatttcaatattctgtgaaaaaattcacttgaactctgatttacctggaaagataatgagtctaatgctcacttgatacagttgacttagcttagtctaagttagaacttcttatgtttttctgttgtttttagctctcaggtctggggaccagaattgtaaccattcaacaaaataaacagatttctaaatatgaagtttagcccatggattcatgaggaggagagattcttgaccaatctaagtcatgactaccataggattttctaacaccccttccccaaaattaagtttcaaaaaaatttttttctcatttcttgtggttgcacagcacaaaatgagtcagaggaaccaggaattttctttttccccactttagttgacctttgtgttgtgcatatgccattttgtactttgagtaacgttgtctccaaaggttctgctttggtttaatgccgaacattggccgtccttaaataagggccacagtccttgtgggtatctccttattggagaaattgcaggtaaactttgtaagcaaagaggatcttgccgattggtctcctttgtctacatgtgttgtttgcatctacctgggacttataattattgtttgcttttccttctctttggctgcttttggccaaacatgtttttatcatcctcatgaaagatttaagttccagagctagccttagatatttgtgtctcttccttttctttgggttagcaggcatctgccattaaatacatcgaattcattccatgttagtgggtcacttctgatgcctttggctgtctgaaggtttggtgaaaaacatattcaattattttacatattaaagaaactacactaatgtttaagggttcactgtgtctgtgtagaatttaacaaacttttttctttagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggtaggaggttggtgtttgatggataactctactgtataaagttaaatttgactggttttctatttctgaatcatggaagtgatgagaggaactaactgatttatctgaagtctggatatgtaataaagtcttcatgaactgcagttgaatgtggctgcattgttactaatgtacagaattttttccatattggcttaacaaaaccaaatagagcagggggaagaaatatttcactatttatttgggatggtagattatcctaagaaatcaatcttaagattttccttgacttaattaagctcaattaatgataattcctgggttgtcaatatttaaaaggtatttctttccccccatctcagcctgcaacttaacattgtacctttcaaaccaaaatgtcatttttttctacaaagtgctggagagggcatctctgccacacatggccccagccatctccaggacagcttcggaagcaaagaacagagttgggcaaagagcaggatgggtaaacattaaatgtttgcttcttccgagatggtcatcttagcatgttttcattgcttaacatttctagagatctggatgtacccatgtccaaatgtaagtgcaaacatcacaattgagtgtatcttatactttgctttcaattaactgacataaaaattagccatgtgtccatgtattgtactaaccaagagttaaacaagatacattgaactggaatttctatttaactactaaaggtcccttttaactaatctgtgacccatatttgaaagctttcttctaccagattttacttattgaaagcaatttgtccctcctctcatctctttttaaccaaactatataaatagtacctgtttgagcttcttgttaggagtaaagaaatagtgcattagtgaacatagtgtcattattgactattaggacatttgttagtttttgtttctctttttgggggaacatttgttattttaaataaaagaagaaactcatttagaaaagtctgcattaggtgaaaccccatctttactaaaaatacaaaaattagctgggcatggtggcgggcacctgtaatcccagctacttggaaggctgcatcaggagaattgcttgaacccaggaaatggaggttgcagtgagccaagatcgcaccattgcactccagcctgggcgacaagagctacactctgtcccggggagggaaaaaagcccagaaaagtctgcgttagaatctcaggttcagatgctttttctcgttataaacaagactggctggagtctcaggggtcctcctgattcccccatgtgccttgtccattgtagtcctaattccctcccaaatattcagcaatttttatatatataggagcccagggctgaagtatttacaaaaaaagataacaagagcaaagctaggagaaaaagtacagccaaaagagctattttcagtttcagttctaggtcactgaatttcattcattttttagttgcccctccctacatagaggaatgagaggagcactttgacaatagattatttgcataatcatggctttgttagatctgaatgttttcttgcaacatgggaatagggaactaaatgcttggtgaggctttcctgaaacaaaagacttagctataaacaggtagtgaggtagatcttgccgaatggccttgtttgtgaggtggttctttgctttgtctgaagttggtgggcagccatgaagaaacaggagggggtaaagtcagaggaatgtgaaattggaatcaacccttgtagcaagatgtctgaaacaagttatggccaaaagtaacctttccaactggtgtctctacaaatacccaaagaatgtgtagaactgcgaatgaggtctcctgaaaccataaacatagccaagtacccctcatttgtatggagtttcactttccaatgtactttcacatcactttgatccctaaattatcctctaagtagagatagagcaaatattctcatcttctatttttctaagtgaggaaattggggcacagagtaggtgaagcagtttgtactaattctgcaatttgtgtagattttgtcaataaacagatttatttccagtgcttccaacttctagtctagtatgttttccactttttgcattgtttttgacacagtcaccggtatctctgagtggttatatcatgtgcccattgctctggaattaataacataagttggtggcttaagaaatacataggtactttaaaaagtgagtaatgcttcctaggaggaatactcttgaaggaatattcaccaacattgctttggatttaaaaacaaaaacaaaagttggacccaaaggatgtgaaacctgctgataatggatccacgcgtcataatatgtttaaagaggaaatactgatgataattaagttctattttgggaaaaaacaagaacacatatcttatagaatcgttaaaagtcagcatcaaagatatcgcagtgtggcagtattgcagacagaatcaccaatgcagtatttactaaaacttagaggaaaaaaacatgatctgagtctgaccaatgctaccaaaaatacttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaatttatatgccatggttgaaaagatgtatcaaactataaagcagcagcatcgaagatttaaaatttagaataaaaattgatcatgtggcatcccaagatataccccaggtataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaaccaaccattaattccagttgtactagataagagtcatcagctgtagaagtgacagtccagtctttctttgcatctctcatcgggcataaaagtaaaccctgttcataccccacatgaaactttcttataacccccttcttccttttttctcattcttctagatttctgctctctatccttaatagcacttatcttgcctctcccacccctttgtcttttgccccagagcatcattctgagtttggccacagctcgttacaggggtctgcctactctggcctggggaagaaatgggaaagaagtctgaggaccttatggccattgcagtcttttccttggcagtccgagggaagcgggaggtgatgcatgtttttacagcaagcatccttgtccctttacattctgtggagctcaggcctcatgcctggtccttgccagcatcatccatacatctctgcctccaaatcctgagatcattgagctgcattctcttgccacctcagcaccaagctcagagattccaaaatcatattgctagaaagaagttaagccagtttcatccctcagctctgcttaaatttgtttttaaaccaagccaaaaggagacatccatattattttctaaaagataaaatatcagaagctattctatgtgtgcctttcagctgatgtgtgaagtgtaaccataagaaatatctcttgccaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggtatgtggatcacctgccactgtttacacaaaactgtcatatcacctgaaaatgttttatttgataatagaatagtcaactaccagcattcctataaacaaatctgactgcatatttttacataatcagtgcccctagtctacttcactaaggctttaaaataggaagcattttgatgatgaatgacttaacctatggtcttctagagagcatttaggagcaccgcagatttgcacagatccacctgctgccaacctagttggacccaaagggatataccttggatcagagttgaaatcatacctgacttggggactttacaatttggcttttttgtggttagtagatgttgagtggcgtcttagtttctgtgctgttctagcctgaaagaacaggagaactaatgaaataaacagatttagcctctctaagaatgtcttctaccttctgtaatctgtcactcttcatttaggccttcaggagaaaccttcattcccaatttttttgctataaattgttcttaagtttgcatgacttgtctaaactttctgattggcaggagaatttgccaggtttagatgtttctcttctgtattcctatagcgccccctaccagtcaccacactggtttgtgaaaggctgtgagtttgttctttttattgtgagttcaaaggggtattattaacaactggtaaagtctgatgctgatgggtttttactttgaagtttcctaaattgaacatttttctgttgaagaccttcttttttgtgtggtcactggtgaactcatctgcttttcccacctaactgtaatgtccaaggcagaaaatgaattttacaaacatttgtcttcttgtatcttgcacatgataggtgcttacatatttaaatttgcttggagcttaagatattattagcaaagcagaaataattaattttataaaagaaatttctactataaatctgacactcaaaggatttttctaggtgggccaatgagtttacaatgtattcctttaaacaaatagtaggcaaaacacacaggaagtgaacaaaagcctaaaaatagtcatctacactgatgagactctaattttgcacaaatttcacgtgtcagccaatataaaattgggaccccacactctccagtctcaggtcacacagcagtgttgcagttggaagatataccacagagcccaccagtacagaatccctctatattagaaaccagggctgaaggatgagagaaatggggtaaggacaggaacgatcatttggagcctttttcctccacctcagcagaggcaaaagaattgacgaagcagccatcaaaccatgaagtcacctcaccacgcctttttttcagtcttctgacaattttccaaaacagagggcatgaggcctaaaggtaagcctactttacagatgtggaccagaagtgaataatacagttaataggaacctgctgacccataaaaccaagagactgtgaaccaaaaggtgtcatgctaatctcatttctcaccaaagtggctggttcaccttcaagtaggaaaatgttctgatatctgagaaggtcccctacgtaaaacactgtgagcttcctagctggctgaactgccccccagacacagtagtcttaacacatttggagagaaatacaaaggcaaaactcctaggccgaggccagctatactccggctacaccaccctccctgccatcagtggtctgccaaggaaatgagtagtggtacagagaatgtgcagcatgatcaacatccagcattctgtctcaagtgcttatggagttaactgggaggtgcccaggtcaatatagaggaagtcaaggagaatctacatagccatattatttttgagcagttagaagtccccgataaaattgcctgagtgagccagaaaaaaaaatctgttcataaacaaaaaagattttatatcagaaatagaaaaaggaatgtaacttgtaaaatataagtggagtagatatctagagttactcttccagaagacaggagaaaattttatactgaagctgctttatactgtcaaggaatttgataagacatggacttaatgaaataagaagacaatagaataataaaatgaaaagacagctgacagctaaggagaggaagagaaataatgatgttatagaatgtaaatgaatttataactgcagaatgcaaattagacactgaacataattggagcagacacaaaaaacttcagaaaaatccacaaaagatgagagaaagaatagatgactaaaaacacactttctcatctgaaaaatataatgcccattttattgcagggtggtgaagactgactggaataattcacataacagatgtttcctagtatttgcttctcaagtgcttgataaactttagaaatggtaagatgatagagataatgactcagaaggcagataatggggatccaatattgatattgttggtgtggcacaggaaaacatcagaaaaaaatgaaataggattagagtaggtaactacaggaggaagtttttttcatgaactgaagaaagctagtatactactttttaggaaaggacataatagtggcaaacaccaaaacttagccctgagaattaatgaattattgaacttcagctcagggagtgccacaagcatcctggtgaagaaaaacaagctactctgaaggaacttcacttcgccaggagcagtggcagagtctgtgggccaagaggaaggggatggcctgggagagtcggtcctcagttgttttaatgtaaccgactgctcttatagatggctggattttttttacctttgaggagagggagaagaggtaaatgtttagggctttcttggctaaccgagatcacacaagtattctgtgcatcagaagttggcattggtaatttgaatatctctatactgagtgtccagttatcaagcatagcagccagtgtatcaagccagatttcccagagagtaatagttaaagtctataaaatagagcaatgacctctgaggtctaagcgttttgacagacttcttttatacagatactctgcacagaaaatatatttatggtactagaaaacaaaacaaataagatggctattataaattttcccacaagttcccataccaggcaggagaatgagactgccatttttgtaaatccttttttttttttttttttttttgagacagagtcttgctctgtcgcccaggctggagtgcagtggcaccatcccagctcactgcaacctccacctcctgggttcaagtgattctcatgcctcagcttcccaagtagctgggattactggcatgcgccaccacacccagctcattttggtattttttatagagacagaatttcaccatgttggccaggctggtcttgaactcttggcctcgagtgatctgcctgcctcggctttccaaagtgctgggattataggcataagccaccacacctggcctgtaaatcccatctgtctgtaattttcaaagtttctttatatcaactgtatacccatatttgcttataataaacagcctctaattagagaagagattacaatgtcatggctatgcacaagagttctgttgttaggacataataggaaaagctcatctcaaaggaactaaaacttacagactaaaaaaagaaaaacagaattttggcaaatgaaagatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagattaggtatttctcctaatgctatccctcccctagttccccaccccctgacaagccccagtgtgtgatgttcccctccctgtgtccatatgttctcattgttcaactcctacttatgagtgagaacatgcggtgtttggttttctgttcctgtgttagtttgctgagaatgatggtttccagcttcatccatgtccctgcaaaggatgtgaactcatccttttttatggctgcatagtattccatggtgtatgtgtgccacattttctttatccagtctgtcattgatgggcatttgagttggttccaatcctttgctattgtgaacagcactgcagtaaacatacttgtgcatgtgtctttatagtagaatgatttatatcctttgggtacatacccagtaatgggattgctgagtcaaatggtatttctggttctagatccttgaggaattgccacactgtcttccacaatggttgaactaagttacactcccaccagtagtgtaaaaagcattcctatttctccacatcctctccagcatctattgtttcctgacgttttaatgattgccattccaactggcgtgagatggtatctcattgtgattttgatttgtatttctctgatgaccagtgatgatgagctttttttcatgtttgttgactgcataaatgtcttcttttgagaagtgtctcttcatatccaggagcaaaaaaattatattcccagccaagctgcctttgtttggaaacgtaaaaaaactcataaatatagaagaataccagaaaattttacataaatagttatgagatgaaacataataatgagctctcaaggtaaatagttaatccttagtatattaaaaaaaaaaaaacagaatggacgaatggggtaattttgccaatgcaggaatgattcaatattaaataatctgttactatgacaggtcacttattcagaatgtttgcgaatctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatataggaactgttaagatccatcacaacacatgttttactggttggactgccatggaatcccagtgacccacgattagggtccacttcccctagtttctgttgtgctgttgggccacttttatgaacaactgttggtgacatcagagaattttgcccatctcagaattgtcacactgtgacaaatcccatggggtagcattttctaaacggataattaatttaaaattttttattttggttatttacatttttatcatttaatgtgtgaacacatacccaatgctctctttgcctggaagattggtaaaagtacaaaatctcaagccttccccgaggcctactgaatcctaacctgcattctgacaagatcctcggatgattttatattcacattaaagtttgagaagcaccgttaagatcactccagtttcaaaactccagataataattcatcttcctgtataattctttatcaccataagagcttaagggagaaaaacccatgtgctcttttcaatagttactgcaaaagcatttgatagaattctagactcattcctgtgtttttaaatgattgcattgaagtttaaggtttttttttgagggcaattggcatctttataataataaactttacagttcaggcattaatctttttccatttattaatctgttccaaactgtaccattataattttattcctttatatttaagtttactcatgtatatttttctgctattgtgaataacatctttattctattgtgttgtttattcttgacatgtagaaaacttatcaattttatattcattttataactagtcaccaggatgaactcttagttctaataaatttttagttgatcctcttgagtcataactaccattgacacttctgatttttttttaaatctttaattttgtcaaggaatagattcacatagccttaataatatagtaagctttaaggacttaaaaattatttgggcttgcctctgcttctggggaaatggaatgcatgttcttttccctattcttccgtaaatacaactaaaagcctccaatattatatataaacaaacataacactcttaaaagtgaagagaaaaaagtcagactaagtagtgaaccttgggacccaaggaatgacatagtggtgagttctttgagttttctttttgtttatatttttctgacctggagctggagaggctggccacccagaaatgccaatgggtacaggctctgatatggtttggctctgtgtccccacccgaatctcatcttgaattgaacttccataattcttgcatgttgtgggagggacccagtgggagataatttgaatcatgggggcggtttcccccatactgttcttgtggtagtgaataagtctcatgagatggtttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacaaacgaaaaaaactgtaatgcctccacctaggcagcaaagcctgaatggcgagcctggacttccaccctcctggactgtaataaggcacccagacttatagaatctggatcttgtgcccactgagcagtaatgtggcagccctccctctccctgctagagtggtgtgagaggagccaaggcagagaggcaggaccttcacaccatccagttgtaatgaggtctttcccctcagttggtcaatggaggccacatggggagtaataagaaggcacccctactctcccagccagagtgatatcaagagaggtccagtaggtagctggaccccctcccagcaataacgaggaggccttccccaccttagtagtaaggttccttgggtcccaagattcactagcctcctttttttctcttcacctttaagagagttatgtttgtttatatagacagaaaccaaatggagaacctagccttctcctcccacctcctagtaatgaggcagtgcccccactttttccttgccaaaacaatgtcaggaaaagccacctaaaacagtaggattaaataagatccaggaccccaaactaccgacattacctaaggttcaatcacttgactgtttggatattgcaatcacaacaatcacttatgtcaagaaccaagaaaatcacaacttaagtttaaaataacaattcctaggtgcccacacagaaatgacggatgttagaattatctgacaaggatttttaaagcagctatcataaaaatgttaaaataagcaattagcaattactaacatttgaagcaaaagaaagaacatctcaggaaaaaaactaaagcctcagcaaagaattaaaaggtttataaaccacacagtaacttttagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttgacatttgtgtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggagacagttctaatgacagaggatttttcataacctaaggaggccagaaggaagtacaacatttttcgggggaatcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgttgtggctctgaatgaagcctgcttcattctctgtggtttctctcaagggatggcgttcagtgtctgtggcttttccaggcacgtggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggcttacagcttgcaccctctgaagcagcagccttagctgtacctgagccccttttagccatggttagatctggagcggctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccatcatgtccagttcacatctttatataagtttgtatttgtatttgtgtgtacaatgatggggtatgtgtgtttacacatgtgcgtatttcagaagatacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaacgtgcaggtttgttacatatgtatacatgtgccatgttggtttgctgcgcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaaaattagaaatactaggtgaaaggctaaataattttaaatttgatactgctaaattccctccccaaaactatacccttttgtagtttcctcgagctcacacttcaccatctatgctttctttgtccaccgattgacatatggataaggcaagaattttcccaaaattactctgactacctcaagcttaaagccataaaaaaaagttttgacattttttatggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttagtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggagcaagtgcccagttcgtcattttgattccatcctgactaaattgttttgactcattacaaaaatattatttttttgaaataacaaaatttcatttaccctttttaaaaagaatgaggtaaatatatacagacatgaaaagaagtttataaaaaaatttgattttttatatttgccctttttaacaaggaacttttacttcctttctaatttgaaaaacagtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgttgatgaagcattgtttaactttatgtggggatatatgaaatgatggtcagttgcagcaccagtgttttcagggatccaagggattcagggccacaagttggtagagcatcctcctttccagtcggggccacagtgggccacgtgttgtggtaaagatacttaatattaggcattattttcaagcattttttgttgttatcaaataccactagcacctagttaatactgtttatgggttttggagaaattccattttactcctttttgccacccagggccttggtaaagttaagctttccagcaggaactgtgcttctccatgtaatttatcacccttactctgctgtcctaagcttagaactagtctcagctgtgagctgatgtgctctgctgtgtttaactggctacccccagagagggtgtccagatgagatctgaagggagggtgcctgacagtgtcccagctccatgcggcctgagatgtgctctgctcttgcacttcctagataaattgggaaacttgctggtaaataattctataacccactcttttccttaggctttttggaaaggatataaacaacggaaggagtatatgcacaggcggcaaacgttcattgataatactgattctattgtgaaggtaaataccctttcctaccataccaagtgcttggcttaaacgtttcccctcatttcatgtttaatctgaaagacagctatagaaagggagggtacatgtgagccttgaagtcagaaggcagtactggatttgaatcccagttctgctgctcatttacctaatcatttttcaagcaggttggttaaaccggtataaaacctcaagtcctttatgagtggttatgagaatcacaagtgaaagtgttctataaccaataaatgttctttgtctagaaagttcaagttgattatttagactttaggtagaacccagctttttttcatgtttctctttccacatttgcttaagcatatttagaatgctcagacataacagaacaaaacccatgataagaggaagtagagctaatttagggcctatatttgggagctgaattagtcgaacccaggtgaatagctctgggtgagaaagaaagggtactgtgatgtccactctcatggatctgaaagccagaggactggacaaaaatcaacttggaaatctacaacttggagatctacaagtctccagcttggaaatccagatgagagtggaagcaatggaactggaaagtagaatcagattagtttaaagatctttcaggccaggcttagtggctcaaacctgtaatctcagcactttgggaggccaaggtgggaggatagcttgagcccaggagttcaagaccagcctgggtaacatagggggacctcatttgtattttaaaaaataataataaataaaaacaaatttaaaaaacgttttaaactgtgaagacagagaataatgtgacccagatccattgtgcagtagctccttgatgaaatagcatcctatggaacatatgcctattctgtcaaaaaccattggtagcaattggtccctcatgagacctcttcgatgttttcctgtaaaaacttaaaggatattggatgcatttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaatttagagtaacatgtaaagcgttttgaaccccttaagaaacctcagtgaaagatgaagagtaggctttagagattgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaatgaatgctttattgaaagttagcattgaatgatttttattgaatggtgaacatgaacacttaagaaataatggatcttagaacttcatatgataatatttggaggcttactgttttcattcagaaatcatgttgagagttagacttcaccagtcaggactcgatagaaaatgggtgaggggaaaactgtgggctagtaacaccaaagagaagactctagagaaatattttacagcattacatatgtagttttttcaactgttaactgcttactttaaatagaagcccctgggagggatttcttcctgaatatttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttcttaaatgttctaaattcaaaaatgatggagtaggtgggactctgggagatcaagacttgtcttaatcttttgcagaataatgaaattgtgaaaatacagtcactgttgagagcgaacaaagctagagatgactacaaaacattgggtaagtgagagctttctgaaacaaagcaaggattttttataaaccaggcaaggacatattggtccatattggtcacttcagaggctgctctaagaacagaggatacccattgtttccagtagattttgatcatctcaggccccaggttctaaaccagtacacagaggagcacatggtgaaaggaaatgggccttcctattaaatggaagggatcagccacatggtataatttcttcttcaaagagagtggagttggcataaatgctgatttttttttttcaatctaagcgagagtcaaaaatctaatgcaaaagagttagccagaaaataaccttatatttaaattgtttaatttgttagacatagtctcatctcccaaaaatgacaactgcaaatatcttcctacaatttcattttgaacttttcacagaataatttttaatttttgtttgtttttgttttgagacagagtctcacactgtcgcccaggctggaatgcagtggcgcaatcttggctcactgcaacctccacctccccagttcaagcaattctcctgcctcagccttccgagtagctggggttacaggcaccagccaccacacccagctaatattttgtattttcagtacagccggggtttcaccatgtgtgccaggctggtcttgaacccctgacctcatgattcacctgccttggcctcccaaagtgctgggattacagattaaattttttaataaaaatttgtagaaagtttgaaaatagcaaaataaaattcacccaaaaataacaatcacattttgtgctatctccttacagtcccaactttgcctatgtttgttattttggttttttacagatcataagttgattctttatatactaaatttttaacattctaattatcacgggaacatgcacagtcaaggagagcttgatgataaatttactagtacttacagtgcctagtaagtttagccagcaccttttattgtctaaagtttgtctgaattaagggatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggggttttttgttggttttttttgtttgttttttgttttttgttttttttttttcttgagacggagtctcgctctttcgcccaggcaggactgcagtggcgctatctcctgcctcagccttccaagtagctgggactacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgtttttggttttttttttaaagaaggctaaagaggatttttttttctgagccctaacactaaaatatgtttgctgttgcttttatatatgaaagatgacttcaaaataaattttccaaatgaacacaggctagttttcattttattcaggtaaagtgtttttttttaagcagttatagtgatgttttttgtttgtttacttttttattacaaagacaaattccaattttaaaatctaggcaactttatattggggcataaaaggtaaatagagaaaccatctcggtgagtgagttagatctaagcttctctgggcttcagcaaattgggtgcttttatggtaaccaaaacataaattttcatttctttcttagttcagcatctttagaaaactaaggctttgggattttctaatttaaaaaaaaaaataacttttctaagtttgttatcatctgttctcccccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatggcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctggccacagtgggagggctcatgttcccctaacttggctgcatggatgagcggtggtgcattgctaaggccttccctgaagtggtcatgtcagtggcagcatctttgctggaaatagaaggaaaataaattgatgtgcttcagtggtcaggaaataaagggtcccatgatccaaggaaaattctccaataaaggccatttatgcagttgtttgtggtttatgcagttgttttggtgttagttttcttactcctttagtgtcaaaacaccacagaactaaggtggaagtaaaaggaagactgtcaagggcctaggtgtaaaggagggcaactaatgagatggccatggctggactagctcttccaagtcatctttctattactgggtctaatcattcgtcctcaatggaccagacaatttattcttacagtttacccagatctgatctccctaagcatgttaaaaatatttttccaagagtcagagtgccaggaaattaaagcctaaagttccaggtactaaggggaaaacccttttagaatttatgtgagaatgtccctctcaataacaggggctgacccctagattctgagcaccctcccttggccggtgctcaaaggacaagggccaagtttcaatttctaaaatctttttatttcagctaagtagaacattcgttttacttatcattctgttggttcctgtttggcttttacagtcctcccttcctggcccttttctaattcagctttcacctacttccggctccttcccaaagatcctttgggctgggagaaaccactttctgcttcctgcagcaagaatgtaagtcacttatctagctcaagcacaaggtctcagggtcgaggtaacttatgttaactttctttcccaggttcctgaggaatgaggcacagataggactatcttcttagcgcatgagtccagggaacagtgtgagagagagctgataaaagggataaaaggggagttgataactagaaaagagtggggccagatatctgttttgtgcgtttatttattgatcagtttccttgtccagattttaaattgtgtgggggtgggtagaatgattctcaccctagaccaagtactttcattggtatatttttctagtaattatttaagaccttgtttctttcctgttgataatcattccaagctttcctaattaaagtatacctgttcctgtcactgcagttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggtcagtggggtttttgggactgtcagctcccagaagagggaagacgcctacatacagtcaagagtcacttaatgacagggatacattctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttataggacttatgtcttatatgaggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatataccttcagaataagactagggcctttatatgaatacaaaagagatatttaaagagtaattaataataaaagcacacattttattgagaaaatgtatatgcctgatgacactggaagacatgatacagttaccagaggtgtagacctcttcacagaacagctacagattatgagggcttcagtggcaaatgaggcaggaactcattttccaaaatggagaacaactatttgtaaagttcaacattagccaagtgtagtctccacccaatttacatagcagttgcaattctagaaaatcctagcttttgtgtggggaaaatgtattatgcatctacataaaacaattagattctaggctcagataattacaaacagaatcttgacccacgtaaatgaccagtaagacattcaaaagttctgtcatgcaaggtgagggcaattatttacacaagaccatcccacaaattgccagatcacagagcacctctcatccccaatccctgctcactagaaaccaagagtgcccttcaattgttaagatattaaaaaacacccctacgtatttccaaaatgtgactccctacaaagacacactgcccccgttatgcccccattgataacttctaaataaattacggtgtggtttcacatctgtgtgaaacctgccaacatcagggctcaaaaaaaaaaaagtataaaaagtgtcatttttacccaagaacagatgcctaagaccactctccctgtccctgttcccttcctatgtgccacatcagttttcagaaaactgataggtcaaagagggaaactgatcttctggaagctctgagaaggctacagtggctcatagagcgccagcggccagcaaccaagcgaacgttctggacaacggggagatgagcagccacaggaggctgccagttacatgggcatgtgaatgccccaggctggtcctccagacctcataaagacaccagggcaattgtggaggagaaaataagaaaaacagcattttataaacagaaataatcatctcttctaaatattcaggaataaaactacagtttaaatgttctacatttaactctacttttattattttatccagaaaaacaacagtactttttaaaaaacaatgttatttgtattgtttgacatccatgagaacttttaaagtgtaatatattccagaaggattttcagagaatgctttttatagccttaaactgctgtttcacgctatccccataaaatcataaacaggaaatgtcttgccttttaaaataaaggcttagttgcaaatcagtacatagtttaaataatatgtatcttttggaaacacaatcatggcaagttatcagatttttatgaatgcttgaggttttgtgggggttttttaaagccacttatcactaatagataacattgtgaagtttttcaacatatttgcaaacaccagatatgtatccagcattttttagcggttaaattaatgattattaaatatgtagctgttagccttgtcattgacagaatattagtagtgatacaagaacagagcaattgaagctttatttatagtagtgaaaaagtgggaaacgacctgaagcccaaagcaatatgcagagggcgatagaattagtttaatatggatgttgtatagccactaaaaatgatggtttttagactattttaaagcaggaggaaaggtttgcgatatagtagaggagaaaatagtgcctaaggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggcaaaaagaatggtttggagaaagaagacagagcaactgaaataagaggtttcctggaggcacaggagccaaaaaataaaaaataaaaaagtataggtcagcctagctggaaggaaagcctaaattaagagactgaagctaatctaaaactagtgctaaaattcccattcatgagtatgatgtatcatctaggagcccagatttgcaggccagtactacctgaaactcaggactgagatttttaactattaatacttaattatactacttcactgcttatattaacatgtggccttgagcatgtttcttaacctctctctgagtgtgttttcttccctggaaaatgttctaggtgatttacatatatttttaatcttcacagcaactcagtaaaattgctgttattacactcactctacagatgaggaaactgaagcttaggttaacctgtgtaggtttaccaagctaattatactctgcagatacccatatcttttatgactccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaagtgagttttgatgaataaaaagtatctgcccctgtttgttatccttgtctgggttggctcttgtgtccatcttcaagcttcccaaagcaaacctccattcacacaagcacattctggagcaagtcagaacctcacagggagaaggaagaggggctatccccattgctgtgccgggctctgtccttggagctccagcagacaggtgctgttccatcagcacagccaccggcccgtcctctctcttcccctttctgggttcagcattgcctccgttgcttccctccctccattcctctcattatcctgccttcaccaactctctctgtttctaatgcagaggaatttagatctgccccagatcttgctcaccacccctaccctctcatctgtatatggcaaaaaccattaaccagaagatgaagtctgcaacaaaacaaaaagcccccagtttctagagtgacctccactgaaaacacttgggagggaaaaggggggaattataggtaacaagactttcctgtcgtatatttaaaatcaaggtgatagatttattctgtgtatttgagggagttgaacgatttacatacatgtcgccagctatctgaagaggaaaaatgtggattaactggcactgtaagccacatttattctagtgatgtcttaggacttcttatagataaggattatcagacagccgcctgcctagattcccccttgacctctatctggtggtaactgcacttcctttctttgtactgaagacattttatatattggtaaaacaagggggaaatgttgcttttttaaaaatgttatcggaatgtaaatcaactcccctccctccttctctataaaagcaattggggtgacagaagtaagtgggtaagtcaaggctgcctctctctgaattgagaatgagaaagaataaaatcatggacctggaaggcaacagatgtagccacatggaactgtcttactccagagcttcctagagctctggaccccagctgctcaatgggctgaccccagctatgggagaatggggtgccaggaagtaaacagatttagagcttgccatttaggcaagacctgacggtggttctcatccccaggggcaactggaaatgggggcgggcccatgtccgcttgtgaaaatgactaggggcccctgctgatagccggtggtgggaagtggccagggtgatagacgctggtagtgcatgcagagcaaaacactgttgtccacactgcccatagtgcccctctaaggacactgggccagcattcctgatgtgcaaatagagtcctcacgtggaggtccagctaagagctcagtcaaaaatctgaaaaaagttttaggaaaagcaactttcttgccacttactctgggacagtgaactaatgttaagtggcaggggaggtgttctagaacagcgactttcaaatatgagtcgcatgccattagggtcatgaaatcaatttagtgtgtcacaatgagcaacctttaaaagtggaatagaataaaagcaaatagaaaatatcagcatgtaccattagtgagagagagggtgtatgtgtgttcactaataaaagatggaaaatgtatttcttactgcgggtcccagacttctgagttgccagtaccacaggcatgagccaccacacctggcttatttttaaaatttgtagagatggggtcttgctctgttgcccaggttgatctcaaactcctggcctcaagccatcctcccatgttggcctcccaaagtgctgagatcacaggcatgagccaccacacttggcccgcttccaacttttcttccgaagtttcctggcttctcttaaggcctcatagaattgaagaaagttagggccttgctttggattaggcttaggcttaaaggaatattgtgctggtttaatcttctatccattccactcaaactttctccatatcagcaataaggccattttgtctttttaatcattcatgtgttcactgaagtagcatttttaatttctctcaagaaatttttctttgcattcatgacttggctgtttggtgcaagaggcctagcattacgcctgtcctagcttttgatatgccttcttcactaagcttaataatttctagcttttgatttaaagtgaaagatgtgtaactttcacttgaatactttgaggctatcatatggttattaattaacctaatttcaatatcattgtgtctcaggaaatagggggcccaagaagagaagagaaaaaggaaagttggtgaagcagtcagaacagacacatttattggttaagttctatgggcgtggtttgtggcaccccaaaacaattacaatagtaacatcgaagatcactgataggctgggcacggtggcttacgcctgtaatcccagcactttggaaggccaaagcgggtggatcaagagggcaggagatcgagaccagcctggccaacatggtgaaaccccgtctctactaaaaatacaaaaattagccaggtgtggaggcgcgtgcctgtagttccagctactcaggaggctgaggcagtggaatcgcttgaacctggcaggcagaggttgcagtgtgctgaggttgcaccactgcactccagcctgggtgacaaagcgagactccatttcaaaaaaaaaaaaagatcactgataacagcgccccgtaatagatagtataataatgaaaaagttctacatattgcaagaattatcaaaatgtgacacagagacacaaagtaagcacatgctattggaaaaaaatggtgacaataggcatgttcaatgtaggattgcacaaaccttcaatttgcaaagaaaaaaaatgcggtatctgtgaagcacagtaaagcaatgcacaatacaatgaggtatgcctgtatttccaattacgtgtgtttcaatcctatatgtgaagggaggagataaagagtatgagaattaaaaaggagtaatctcatcaaattttttacaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacaggtgagaacaatttatcgttcactctgagtttgggagtaatactatgttacatgtttgtggcttacagggagtattttgtcatgcttcagctataatagcatacatgttttgagcatctactaagtaccaagtgctgttgttggtgctttacatacattatctcatttaattcttaccataaccctgggagccgtgagagaatgagtactgttgttattcctgcattacagatgagaaaactgagacacagccagtaaatgataaagcaggggttttgaaacgcaggcagtttgacttcagagaccatgctctttacagtattatactacggttaccttcagaaacaatataaatctgataataacaaaacaaaaacaggtgctgtcatccatgaaaaaattaaaataactgtatgtgaaaaacagatatttaccagaaccagtctccccttctatgggggaagagccagagggtttgggatttcaaaataatatttcttttttcttgtattattttcatggcattactatgatctaaatgaatagtaattttccattgcttcctgagtgttggtgagaactgataagtttgactggttatggttggactttgatggatcacttattgttttgtttgaccattgattcagcccgtcagccctactagcacatacagctagtcacagaggaaactgcatgatagcaatagaaattaacaagcatcctcttcagcaggaaaagtttccccaaagaggtggatccatagttctcccttgtaagagtcagatgtctctcagagtggggccactgctgggattccttcaaagcctggagatgcttagatctttgtttgaggatgtcactggcagtagatgtatagagagcacattacacaaaccataaataagaggcgtggctaacctcatggagaaacacgatgttaattttggtaggtttgaaaattctctacttggaataagagattggagaacatcttcaaacatacgaacatcttcacacaagtggccaccacatggcggcacagaaggaaaaggttaacagtacttagaattgtctgtggaacccactgtttcacgccagcaaacctagaaagaaagggggctcactttaaacaggaaaggactttggtctgcctaatttagtagtcaaccaccagtttgaaatttaatcttaggcacttatcattttttacacccatgaaatttcaagcatattgaagattctttagaatttagttttctcaatttgacagaatttgtcataagttaaaatctagtcattgtttattatataggtggaggcacatttatgggaagaagaaaaagtgcaggagcatgtttagaataattccaccaaacttgatccgcaaacaatccaaaatgtacaaccaaagggtgcaaccattcagttgtatcaagtgaactctctcttgaaatcatatatttttcttctccttctcttcttttgaggcgttagcccaatatcactaaagaaattatagaaaagcaaatggcctggattccttcgacccgttggttacactttagcaagacttctttttttgtagagacaagatgtcactctcccacccaggcaggagtgcagtggcgcaaccacagctcactgcagccttcatctcctgggctcaagcaatcctcccaccttggcctcctgagtagctgggactacagacacctgccacaatgcctggctaattttttcatggtttttgtagagacagggtttttccatgttgcccaggctgatctcaaacacctgagctcaagtgatccacccatctcagcctcctcctaaagcactaggattgcaggcatgagacaccacacctgacctagcaaaaattcttaaccaaagccgcagtcagctagtataggtttttggggggtttgtctcttcagtatgaacctaaatttaaaatttttaggtaaccttaggaggaatggtgagtaggcatctttctttagttatagagtaagtttcctttctcctaattcctatatacttcacattgaaaaacagtcactacagagctatcaagaaaaagtactgagctgcttatttataaaatttcaaccaatcattatgaacttaaaagtaaacctaagtgataaagtaaaccagaatttaaggcttcttaaaagctgcccaaactgcttgagtatattagatgaataccagttttcaagtatggaaaaattttcttctcttgtcagaaagaagatgaagattaggagtattaaatttctctttgtacatacttcctctataacctgaacattattgttctctttgaacttctacctggtaggtgtagctgctggagaaaagccacatcaccatgaaggctggttctgtatccaatgggtccatcctcatcagagcccacagggttccacgtccattttaagttctttgttgttttttgctcatggtcttctggcacttcccttatcaactgtcctgaccttcacccctctcttcagcctccctacctcactcccccttctcactctgtgtagaacattgtggccattttgctgtttccacattgtaaatgtattcttttctttttctttccagtctgacaagatagtatgcatttctactcatctatcaatccttctaggccagtctatgtagccgggcccttagtccactttctttttttttttttttttttttttgatacagagtctgtgttgtctaggctggaatacagtggtatgatcacagctcacggcagccttgaaatactgggctcaagtgatcctcccaacctcagcctcttgagtagcagggactgcatgcgcacaccaccacacccggctaatttatttttacttttttctagagacagggtctgtccatgttgcccaggcttgtctcgaactcctgggctcaagctatccttctgcctctgtctcccaaagcgctggaattataagtgtgagccaccatgcccaagctttgccagtgtctttggacaccagattctactggctacccgccctgttttctgcgtctctacaataaatattaatatgtggttcaaaaaggtcaacagtgaaaagtagatataatatgttaagtgtatcatatagtgtgtatcatttaaatcctatcataattttctactatagcttcctatagtatgatatgaataatattaagtaattaatatttgatattaatattttaaaatattaatatatgataggaagctaaagtagaaagttatataatatcagtctataggaaactgtagtagaaagttacactatatactaatagcatagagatgagtacctggcatataaaaattattttatatactcatctatatgcttttagtgacattaagtcattgaagagcagggaatcagatactgctttgtgctttaataatatattaacttattgttttgtgggatttttttgttttctttttccttctttccttctagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaagtatgtatacaaatatgtatgtaaaaataccagtgaatcaatccttttgttagtggtggctgtctttgatttactaaaattatttttaaattcttataagttattcccacatattaaaatatatcaagtttcttgagaatacttctatattattagagctatattcaagtaccattttctcccaccagtgatactttctctagtgttaaattaacttttgattttgtatgcctgtaacaactgaaaatcaatagcatattgaaagtcagtgaaaacatttaacttaattaaaattctgagtagtaaagccattaacaggtgggaatgcagagtgcaatctctgcctaaatagtcttcccttctttctagaacttaaactacttttgctaatttattttctgactcagttaatgtaaaaattgtataggtagctataatgagtgggctgagaaacaagcatgagaaatgtccttagctcaggtggcctccctaacttgtggaaaccttaagttataccagttcctattggttttgggagcacgggagccaggcacctctgcccaccaggtgtctgtaagcccacgagacatgtgattcgtgagaaataggaatgctatgcagtggaatgtggtaagtactaaatgaaggacgcgtctaaatgaaggacatgtacaatgtatcaggttagaggacaggaggaaagattccaactaggttgactagtaaagattttatagaagaggaggtgcttgacctaaaaccttgaggaacagctacaatttttataagaagagatagaagagggaaataaggcacaatggtggtggaaacagcatgggcataggtcccaggaggaaagtagattagtctagccagaaagtgacttaattactaactaccaggagatgaatcctgaatgatagggtagggccaggtagtgggagactctgagtaaaggcccagctgttaaggctctatttgctttttggggatctgtgaaatcttttttcttcttcttcctaggccggagtgcaatggcatgatctcagctcactgaaacctctgcctcctgagttcaagcaattcttctgcctcagcctcctgagtagctgggactacaggtacccgccaccacgcctggctaatttttgtatttttagtagagaagaggtttcaccatgttggccaggctggtctcgaactcctgacttcagggggataggtcccagagagatggcgggtgaagctgtgcatgcacgtgaggtctgaggggagaacatgggttttggttgggctctggtagaccagttattcttttgtttgggcattgattcaccctcattcgccttacaagcacctacaattagtcaaaaaataaacaaaaaggccgggcacggtggctcacgcctgtagtcccagcactttgggaggccaagacaggcggatcacgaggtcaggagatcaagacatactggctaacatggtgaaaccccatttctactaaaaatacaaaaacaaaattagccagacatggtggcgggcgcctgtagtcccagctactcaggaggctgagacgggagaatggtgtgaacccaggaggcagagcttgcagtgagctgagatcgcgccactgcactccagcctgggcgacagagccagactccgtctcaaaaaataaaataaacaaaactagcatttaaaggtgggaagaggagcacagcaaagaaaataaaaaggaatgactgggtaagataagaaccaggcattgtcaagctctaaaggggaaggatgtggaagagggagagaaagtggtcaaaagagaaaggggaggaagagaggagagaggccctaagaatcagcaaccataaatcaagaaaagctctctcagccatctgacgtggctagaagctgtattgcagctttgagtgggatttgaaaaagtgaaaacagttcattcaatcaagaaagttgtttttgaaatttgataactacaggggcatggtacttgtaccgtgtcacccagtattgctagtcctggtccattttcagctcatacctgccttctagattgaaattgaggctgtgactttattttcagatcctcaaattgctcatctaagaaacatacacgttataaactgggaacagtggctcacgcctgtaatcccagcactttgggaggccaaggcgggtagatcatttgaggtcagaagttgggaccagcctggccaacatggtgaaactctatctctctgaaaatacaaaaattagctgggcatggtggcatgtgcctgtaatccgagctactcaggaggctgagataggagaatcgcttgaaccctggaggaggaggttgcagtgagccaagatggcgctactactctccaacctgggcagtagagtgagactctgtctcaaaaagaaaaaaagaaatatacaccttataaatgattgcttgtttttaaagcacaccaacttagattttcatagagaaaagtataattccatgaagtccttgccttccagagggagaatacattgtttaaaactgtatccaggcccagaaccatggctcaggactgtatttccagcactttgggaggccaaggcaggtggatcacctgagatcaggagttcgagaccagcctggccaacatggtgaaaccccgtctctactaaaaatacaaaaagtagccccgggcatgtggtggtgcacacctgtagtcccagctactcaggaagctgaggcaggagaatcgcttgaacctgggaggtggaggttgcagtgaaccaagatcacaccactgcactccagcctgggtgacagagcaagactgtctcggggaaaaaaaaaaaaaaaaaaaatctgtatccatggaagcaaaccattttgttttgtcttgggcttttttagatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccaggtaatagaatcaggaaggtgttggtcttctgttatgttttatgatatttttacatgtgtatttattgatactcttaaactttgttaggcgaactgtacaaagtcagttatcaatccaaaatgttacctccctttaacatatccatgcaaattacatcttgatactaaatggtattttcacatttcagagccaggtgatccccaatgccacaacttccataattctctcccttgtttattttctttgtgtatttctaaacctagacctagagatggtgtagactctctcttcacctgataatacgtacttttctttacagttaccaggcaagtaactttaaggtgtaaggtttaacaatccaggttggattggcttattctgggtgggtggttgtagatttaagcaaccctagcttcttgtttcctgtaaaaggatgtctgtgaaataaagtgtacacagagaattatgtaattatgtgggtggttgttacagtactgtttgtaataataaaaagtcaggaaaagtcaaaatatttagctttgagggatttgttaaataaatgtttgtatagcacataatggaataagtatttggaatcgtggtatagatatacatttgttggcacagaaaaaaatgttcagggtatatattccagttggagttaggtgcaataacccatttttctgggaaaagaatgctcattacatacgccacacaggatctgtatagaatgtcgattacacaaattgcattacacccatcaatatgcgaggcccacagacatacatgcacagaggagattggacagttatgcactaaggtatgaaaattggttgtcccaaacaccgcatattctcactcataggtgggaattgaacacatggacacaggaaggggaacatcacactctggggactgttgtgggattgggggaggggggagggatagctttaggagatatacctaatgctaaatgacgagttaatgggtgcagtacaccagcatggcacatgtatacatatgtaactaacctgcacattgtgcacatgtaccctaaaacttaaagtataataataataaaataaaaaataattaatttaaaaaaaagaaaagaaaattggttgtcctctctggtattgttttagattatatgtgattttatttttctgtaatgaacatttgctttttataattaaaagaaatttagctgagtctaaattacctgggtctgcctcttatcttgccagaagagaccagagggaaggcctcaagtccttcctgttccaagttgcagaaggtaccctctgtgaaggtggagcctcccctcatttagtaaacattttgttactggagtcagtggcaaagtccaattcactatacaaagcttgactatagaaccaacttggcagcaaaattaatgcttgtacctaagcctccagttaatttaaagcctttgtgttttcagcaagttgccttatgatgtgaccacagaacaagctctaacatacccagaagtgaaaaataaactggaggcttccattgagaacctgagaagggtcaccgacaaagtcctgaattctatcatttcttcccttgatctactgccgtaagttgtacttgcagcaagtttaacattctttcctggaacgttcttggaatacgatgtaaaataagcccctgtagtgaagacagcagttttcccttatattgtgtttactattttaaaagattgcctacatttaccttttaaattcctgactgttctctaaagaaggggcaatacttcagtagcaaacacagctcagttattatcatcagtggaagtcctgtgattccattaccatctcatcttatgtttaatttttagaaaaactactcagctgaagttgactggaacaattgctgtgtgttttttcctcactccgccttttttccattattttcttttgtcatctgttttatatgtagttatggattgaggtatatagccaaagtactgaagaattcgatccatgagaaattccccgatgcaacagaagatgagctattaaaggtagattttcaagggtaatctcaccatagcttctcctgggggtatgaatcaaaattaccaacatataactttgtaagattattccccatgtatgattatttataataagctgcaggtcttctgtttctaatgactctcaagataattgattaagctgaggttaatttggagatcctagacattattgaaattctttgcattagagcattttgggggcaatgagcattttttcatcaaaaataactttgcaaattatgctattaataatgtgtgattatattcattgcctttattaaactccttgttaggatttacatcagaaaatgatctgctttctcttgggaaatgtaggagaatatatatctttaaaaaaaaaaagaaaactaaaactcttgagttttctctcttaaaaatggtcatgcacttctgcgtcactccagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggtgagaggggcccttagttttggagaaacgtgcaagaatggtaggcaagaataatatgtgctctgtgcccagagctagagtgggcatggaggacaggaaccccaggtggttacaagcatttcttctaccagccactggggaaagaggagagagggaagtgcaggcaagattgcctctgtctggcgatcctatcgcacccccaccacagcactcctattacactgagtcttttctgtgtgtattatttctgctgctgacaaaatggcatacttgttcttccttgtatgctacaggcttccagtacctagaatttaaaaatcaaaatagcagatttctgcttctttcaacttaagaagagaggaatcatttttaaaaagttttccggtgaggaagaacttgcttatctacgtcagatacatttgacccttgattaacacaggtttgaactgctcgggtctatttatatatggattttttcaaccaaagacagagagaaaatacagtattcatgggatgcagaacccacatatacaaacagatgacttttcacatacatgggttccacaaggccaatttcaaacttgagtatgcacaaattttggtgtgtatgggggtcctggaaccaatcccccaaacataccaaggaacgactgtagtaggaaatggaatacttgattttgaaaggttaggaaaacccagattttatatttgttgatgattgtgtatgtgaatatgttctgttctattctcaagcctttcttaatgacacatgtaagaagatttaattctattgattttgtgtttccaaattatatcactaatcattaacaagaaaggcatgagtctggtagtcagattcactcctcctggagctctgaggaaacactttcctcttgtcatgtttgttctcatgtctgccatttaatcaacaggccatagaagtgtaacatcagtttggcctcttttaatcctcacttggaaactcatttctcattcctcggtctcccttggagtgagtgacttactagaaaacaaaggtagttcatgattattcatttctatttagaatttgtggtcttttgtgagaaaattgccccaaatcctcctactacagaaagtgttgatttttcaagctaatttttcattctcctcactgactaacaaagtaatatccaggctgggcaacatagggagacctcatctctacaaaaaatttaaaaaattatctgggcatagtggtaagcacctgtagtcccagctactcaggaggctgagatgggaggatcacttgagccttggaggtcaaggctgcagtgagccgtgtttgtgccactgtactccagcccaggtgacagggtaagactctgtcacacacacacacacacacacacacacacacacacacacacacacaaagtaatatccatttcccacatttctcatgaacttttaactgctgttattcctatcagtcatttatgttcccacctattctttatttaaaaagaaacaagaccaaagaagtgagcctcttctaaacttgtcctttcttccactcatatttatcctttgtgtttctcagaaatctacaaaaaattataaccaaagcagcataggaaagccgactgttacatgggaacatgctccccacaacagggctctgctgtttaacctcccccagcctctggctgggaaagcagaggtcatttctggtacataagacccaggtgcctgtaggagagatgccgacaatgatttcaggcatatgaaacatttacaactttatagaataaaatgtatattcgacctgcacaagaattgtttaggcaaaaaatacatagaactattcaactgtgatcacagcatgcctcacttctcttgatctctgtcaaaacttgctttagcttaaaatagactttttagggtctgagtcctgggacatgttatgtatttgggtgtctagccttaacaatctttccatcggccagcaaatatttgcagcaacgaagaagagtagacttaatctcatttttgtcaaactggtaacagaagctctgaagggtgattagggtgatgtaggcccaggagcctgtgctgtttaaagcagcaaatttgactaattgcttttttttctattgtattcctcacacagacttgattcttagatcaagaattatcatttttgactttttaagtttcagggaccatttttaaaataacatttttaagatgacctacgcataggtcactatatcactaagtcacaaacagggcctgaggcccttgccactctctccaatcctgtttgaggagctgggtccaatatccagaaacatggatgcagctccgacagccaggagccagcctggaagaagctgtaacacgtcctctcaaggtttgagatgggaacaaagtacatgtcatcattcaaaatttcctagctattttgatgaaactgtttaatgcacatgtttgagtctgtcttaagacttttcccccctttattaggaaatatttcaaagaagcatgtaatgtccctgagccagaagagaagtttaatatggacaaatacacagacctggtgacagtcagcaaaccagtcatttatatttcaattgaagaaatcatcagcacacactcagtaagtggggatggggagccatcttagcaatggacccatgatttaggcatctgttatcttgaaaatgcttaatctctacaggacttattgtacacatgtgctaatactcatattcttaaccctaaaaatctcgcaattatttattccatgactcttatacattaataaaactccttctcccaaacaacaaaattctatttttacataattattccctgactcctagacattaataaaacttctccccaaaaaagaaagtgtacttttggcataatccatttacaaagccagattgtgactggaatggtggcatatgcctgtaatcccaacactttgggagactgaggcaggaggatcactcaagcccacaagtttgagactagcccgggcaacatagtgagacccctatctctactaaaaattttttaaaaactagccgggtttggtggtacatgcctgtagtcacagctacttaagaggctgaggtgggagatcacttgagctcaggagtctgaggctgcagtgatctatgatcgtgccactgcactccagccggggcaacagagcgagaccctacctcaaaaaataaataaataaataataaaaataaagccagattgtaaatatgcagtttaagccctgagccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatctggtttgcatgcagacatcactgccgtcagccattagcatgtattaagtatctgttgggtgcagggcactgtgctcagtggcatggggaaggaattgggaggctttagatgacttttcaaacattaaaattaaaaaaaaaaaagctaagcattgaggggtttgcattgttttctttttaagatcaattggaacttatttcatgaaaaaatcttggtttttaaaaggtaaccatttcaagaatagtttcagaccttgtgagttgaagcaaggtcctggggatatgttagcaatgcaccctggacctcccaaattagaacctgcattgtaacaagatcccagaggattcagatgcacattcaagttctagatgcttcagttaaggatgcacccaactttggattatacagagaaccaaagggaaagcataacaaatacacattctcaaaggttgtgctctagcccccatcaaaccagacatactgacaagtggcaggttagctgcttaaaatttcagtctattattaagctcttctaagaaactaaagcttgaatgtaggtttgaaggaaagattgaatctagtattgattttcttctttcagggttgaaacagggaacttccctgacatttacatcaagctctcaatacatactgattaaatgaataggctatccttcttttctctatatatgaacaccctagattacaaggaaaactgtccagcaatctagcaatgcattacttacagaaataattatctactggacagactcatttatatttgagcaatgacccatttgtctgtttttgtggtacattatctgtcttcaaagaatatgtacatcttgggtgcacatttgctgaatgcaatatccacatgcgaaaaaaatggtggggagtacttgtttagagtgagagattctttcccaagggtagcagagagaaaatgttactgtattaatttagaagtcttagaagtctttaaggagaaatagtctgttcttttgttaacaaaaattgaaaacagaattcaatcctgggaaagagagcttgtgactgatttggaattccttcctgtgttaggttagaagcagatgtaatgtggggaaattgtgtaatttcataggaagactgtcctgtttactgtctgccttctgtgtggaggcgtccgtgtgcagacacaagcacagcagtagcaggatttgccaagcctgtggccatgtgcttacccctttctctaaggaagatgcaagaacttccaaataagctctttaagaagacattatcaggaaatttttccgaataaagggtagaaggtggccacctaaataatcatttccaaagaaaacagccaaatcagttgccctggctcatcagagaagaagaacataaatttatccatcttgcatattttgttcttgtctcttaattttccctccaaaacatcatatgtaccgcctttccagattttgcccggtctttgtatcacctctattatttatttaatgcctttctttgaatcaactcacctttttaaaaacaacacgtaatttctttgctttaaaacaaagtacctctactatagtgaaaaactagcctgctttgccatacacagaaactttagaagaaaataagtgtaatgaaaacaaaatagttggatacagtcacttccttaccttgaagttatgtatctgaggtgtgttctctctttgttaacaactctccatgtgtcagggaaatgttaagaaaaatttagcatcaaacagatactctctccttcactgatcttaaagattagaagagaacggaaaaggcagtaatcaagacagtgctatgctggcataaggttagacataaagactaatgggatagaatcgagagtctagaaataagccatcacatttatggttaattcattctgacaggggactaagttcaatgggaaaatagtgtctccaaatggtactgggacaactggaaattcccatgccaaagaatgtagttgtgccccttccttccactctatacaaaaagtgaactcaaaatgggtggtagacatagatgtaagagctaaaactatagatctcttcaaaataagatataggagtaaatctttgtgaccttggattaggcagtagtttcttagatatgacaccaaacacataagcagcaaaggaaggaaataaactagacttcatcaaaattgaaaacttttgagctataaagagtaatatcaagaaattgaggctagacgtggtggctgacgcttgtaatcctagtactttgggaggccaaagtgggaggatgcttgaggccaggagttcgtcgacaaaataggaaaaaaaaattagctgggtgtagtggtgcatgcctgtagtcctagctactcgagagaatgagacaggaggatcccttaaagccaggagttcgaggctgcagtgagccatgatcatgccattgtaccctaacctgggtgacagagtcagaccttgtctcatttaaaaaaaaaaaaaaaaaaaaaaaatttcatccaggtgcagtggctcacacctgtaatcccagcatgttgggaggctgaagcaggtggatcacttgaggccaggagttcaagaccagcctggccaacatggagaaaccctatctttatttaaaaatacaaaaattaaccaggtgcggtgacacatgcctgtaatcccagctactcggaaggctgaggcacgagagtcacttgagcctgggaggtggagcttgcagtgaaccactccagcctgggcagcagagcgagactttgtctcaaaaaaaaaaaaaaaaaaaaaaaaaaacttgagaaaaccaacagaatgaaagaaaataattgtaaataatatgtttgattggggacttgtatccagaatatataaagaaatcctacaactcaatgatagaaacataatccaatttaaatattggacaattacacatcaaaggacataatcaactgagtgaaaagataatgtatggaatgggagaaaatatttgcaaatcacatgtctggtaaagggttaatatctagaatatataaagaattcctacgaatcgacaacaaaacaacccaattataatataaacaaaggactttaacagatgtttttccagagaagtatacagatggtcagcatcactaataattagagaaatcaaaactgaaactgcaaggagataccactcacacccagtaggatgattaatatcaaaatttaaaaaaaaaaaaacagaaaataagtgttgagaaggatgtgaagaaaatgcaacccttgcaccccgttggtgggaatgtaaaatggtgcagctgctatggaaacaggatggtctttcctcaaaaatttaaacagagaggctggagtatggcggcacgatcaattaaaaaaaattaaacatagaattacctcataatctaacagttccacttctggaagtatacccataaaaaattgaaagcagagtcaaagagttatttgttcactcatgttcatagcagcattgttcacaacagccaagcgtctatcactagatgaatggataaaatgtgttatattcatacaatacaatattattcagctctaaaaagaaggaaattctgatacatgctacaacatggaggaaccttgaagacattatgctaattgaaatgagccagtcacaaaaagacaaataccacttatctaaggtacctagagtagtcaaatacatacaggtatatttgtggtttctaggggatagaaagaagagataatggagagtgactgccaatgggtacccggtatcttttagggcagtgaaactgttctacagtcagagagtggtaatggctgcacagctctgtgaatacactagaagccattgcatcgtacattttaagtgagtggatttgatgtatctgaattctattttggtaaagctgttggaaaaaagattgaaaatggaaaaggaactagctttatcattatgatgcagagttttataaaatagttgctgagaacaacaaattttatctcctgtctccaagattactagttccgtactttggaaatgttgtttcaatctaattagaaatgcaagcaaaaacagatgtgtcgctgttcatgtgtaaggttgtaacaattaaaccaactccattaaaatttgtttaaattaaaaaaaaaaaaaaagtgttgtctttcatggtttcccccgagtgctgctacccctcaggagttaatactgtttcctgtaagacctggcaagacaccccagcagatgttactcatctttgggccttcttaggataaggaaaggggaaaccactcaggacatctaggtctcttacatccttacccatgagagatcttcaatgcaagacagattgaaacagctcatagtagtgattaagaagaagataactgtagtatttgattactgcatagagatgtaaatgcccttccagtttgctaccaatgttaactgaaagatctgcctcattctggactctttcccccaactttgactttttctatggaggaagagtgaagcacagagatcaggtggtagaaggcttccctttggcagaccttgctgaaaaagggtttatgaacacgtttcttgcaacaatttcttgatgtagagtaggtgcttccctctgagatacaataaaaactgtatctatgtctctaatttttataaatgtcatactcatatttaagatttaaatggtatgaggaggaaattatgaaaaatttcatataaatatggtacagttgagaatttacttttttctttgtgtgtgtgttgctttctacataaagctcctgttggaacaccaggatgcaattgcccctgagaaaaatgacttactgagtgaattgctggggtcgctgggagaggtgccaaccgtggaatcttttcttggtaagagcttgttccttctacttatcccttggtttttgtttaattgggtgggttggttggttggttcgttggttttcctatcctagataaaacaattattttggaatttaatgcttaagcatatttaaagaataacaactacacttgccccttcctacagtaagagttctgtaattaatggagtccgggattataaaataattcagtattcttgaaggtaagctccagatatgtcaaaaaggaattgtcaacctgtattatacagaaagaagccatcaataaagaaccaaatttattacaaaatgaaaaatacttttattaacagttatcctttttagtaatttgtatttgaaatacctatgtcccatgtcattttcatttttcaatcagatattttaaaagccactttagctatagtagaatgtgggttttgtaaagaccatgatctcccatttaattaccaagcctatctttcccacagaacctttatcttacattgttggtgccatcatcacaaagagtgaattggaaaaataacactaggttttttccctacaggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagtaagtttgggggttaaagggcacatgtctccaaatacacatcttaaatgatgcaaattcaaatgaggctaaatcccaactaatttatttaaaagtatgtgaacattgaaatctattatgtatatccatcaaacatctaaccaaaggataatagactctttagaatttaggaaggcattaaatattataatagtttacaacaccttccttggtttttagttttccatgtagtaatttgatttttttcctttgagaaatgattaactcagcttatgcaagtccttaggtaactgaagagaaatatctattacagagtggccagaagattagtgaggaaattcagttaaccaacgtttatttccggtataaaatcataatataaaaacacgtacctacaataagacattatgatagcatctgatttattggccttccttcctgttaaactgatcctggatatatttaccagctttgacttttatttgtaccctgcttcctgccgctaaagatttcaagtgaagcattcacactttaaataatactatcttttctccatcaaagaatcaaggatattccacatccatcctttacacacagagtaagaaagagaatgagattcatgatacaacaccataaatcaaaagcacccgctgaccaagcagtgcagttttcaagaacttatacaaacccaagaatgcatatcagtacattagaacagttatgtattggggtgagatggagactggaagtggaaaaatgaggacaaagggaacaagtatgtgttgaaacaatacgaaacatattacttccaagctacctgtcctgagttctgaggttttaatttgtggcaagagctttctctcctgccactgatgtgctgaagtgtgcttgaagtgtgaatgaagacagcattcatctccacttgatttttttttttaaacattcaatcatctgtgaaaacaacaggaagagcttcttcactgtgctgtgttgatatgttcctctcttaggcttgttgattttgtcctcagatcatctgaggctccattcggtcatgcagcaaatgcttgactacctactctgtgttcatgcgctgggcttgaggctgggatacaacagtgggtaagctggaaacagcccctgtcttacaggggtggagagcacagttcgacagtaggaccgcaaccaagttgcaggactaggactcacccttggcctcacaagagttgagggcggttctttttgactacagattaccaaggcagatgaaaatttcagggagacaattcagggcagggcaggagagaaagggggagaaagtctacaccctgggttcctctgaacaagtgccaattataaagataactggaaatacagattgtgtggttttgccatgtaaatgaaattaggccaagtatcccatgatctcataagctttgtcctttagaagtaatgggaagaaattttttcttaattagttttgtctgctatttgaacatcattttctaaatccagtcaactccaatgtctgcatgatatctgagaatcaccatttgagtagttcaaagtatcagataatctgaatatcatatatatttatacttattcctgaacatgagtctgcatgattctgcaaattctaggaaatcacatttaaagataaaaccataaaagtcaggcctgtctggaagcaatgtgtcttagcctgggaaacctgggacattgtcctgtttgccttacccattacccagcctctgcccttgtgtggctctcccccgtcccccccagtgtgttggaaacaaacactatccacttctttaatcaccacactatgtagagccagcagtgggtttattttttattgtggtaaaatacacataaaacttaccatttcagccattttaaagtgtacatgcatttagtacattcgcagtgtgcaaccatcactgttgtctagttccagaacatttttatcagatgtgaaccctgtacccattaagtagtcattccccattccccgctgctgcccagcccctagcaactactagtctgcactctatgtctttgaacttttgcctgaagatatgaagtcgtatctcactgtggttttggtttgtacttttccaatgaccagtaatgttgaggatccttccatatgtttgtcatccacttgtgtatttatgtattctttttggagaaatgtctatttaactcctttgtccattttaaaattaggttgtttgtggttttgttcctcagttgtaagagttgtttatatattctggacactggaccattatcagatatatgatttgcaaatatttttgccccttgtgtgggctttttactctcttgataatgtccttttccgcacaaatgtttttttttttttattttgatgaagtccagtttatctgttttttttgttgttgttgttgttgttgttgttgttacttgtgagatttaccccaatgttttgttctaaaggttctatagttttagcttttacagttaggtctattaaccctttttgagttcatttttgtgtgtggtgtgagacaggtgtccaccttcattctttcttgttgttattgttgttgttttttgtttgagacagcgtctcgctctgtcgcccaggctggagtgcagtggcatgatctcgggtcactgcaagctctgcctcctgggttcatgccattctcctgcctcagcctcccaagtagctgggactacaggtgtctgccaccatgcccagctaattttttgtgtttttagtagagacggagtttcatcatgtcagccaggatggtctccatctcctgacctcatgatccgcccacctcagcctcccaaagtgctgggattacaggcgtgagccaccactcctggccccaccttcattcttttgcatgtggatgtccagttgttctagcactattagttaaacagactattctttcttcatagaatggtctaggcacccttgtcaaaaactaattgacaatacatgtatggctttatttctggattttcaattctactccattcacttatatgtctatccttgtactagtgccacaccatattgatcactgtagctttgtaatgagttttgaaatacggaagtcctccaacttctttcttctttttcaagattgttttagtcttgcagttgaataggtctcttgcagttatatgtgaattttaggatcaacttttccatttatgtaaaaaaggcttgaggccagtgttttaatagaggccctaagtcttttatgctcaaaggccttcctcttggcatactgtgagatcttactgttggccgaccactttactaagcagcccagtgatcaatgtaggtaacaatttgaaatcaacactgactggttagccatccctgaaagtgaaatttggatattgcccaaaaggttcaatagaattagttctatgattttagccaagccctgcttctaaatatacttcctttaaagtacatatttgaaaaaatcttgatactaacagataattacaaagtgcagcattgacagggaacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccacctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgcaataataatagaaacaaagtgcacaataaatgtaacgcacttgaatcatcttcccgaaaccatcccccaccctgtccatggaaaaattgtcttccacaaaacctgtccctggtgccaaaagggttggggaccactcctttaaaatattgatttgaactctcatgaggatgacttttttgatttgaacactctcatcaggatgacttttttccaagctaataaaccgaatttgtaactcaagcataagatatagttcttgagattcattagagaaccaaatttaactaaaatcggacaatgacttttataagttatgaagtggacagacatgaaatgcagagcaattgggatgtgaaaatacctagcttttctctatcaaaaaactattctgcttttttgtgaaacagattgtgttcttaactttcagaaatgcccttatgtttaattacaatgtcactagttttccagtcatgagtaactcatcttcatggaggcccccacagtagcagaatttgaggcattgttaatcattatgtttgtaaatttaattccatgctagtctcataattcttactcatcagatgaagatgaagatgatgataatagcaaacacctatgtagtgcttaccatggccagggacagtttttatatactgtgcaaatgcaaagtgttccagaattccaaaccttttgagagctgacagtggtcaaaggaaatgctctttggagcgttttgaattttcggatttaggatgctgaagcagtaagtatataatgcaaatgttccaaaatctgaaaagataaaaaatctgaaacacttttgggcccaagcattttgaaaaagggacccacaatctgtaaagagagaaagagaataacatgtgcatatatatatattaaaataaacatgtataaaatatgtatgtaatattctcagcaaccccaagagagtggaggttattatcagtattttacagatgaggaaactaggcacagaacaggtataaaccttttcctgggtaacacagttactaagtggagcagagattcaaacccacatgatttgaaatcctccagggcccacactcttgatcataaagttttacaacttgtcgagggcaaggtcattgttctttgcattcttaggaatcttagaataaataatgagaattattagctgagcagttactgagtaacggaggctggagcatctttccaggccaaagaggagggacaaagggcacatatcggagtaggaagaaacatttatttctttttcccttgtgtatgtttatagaatagagaacctcagtttgggctattgctatttttctaatactaccaagcacagggatatttaaaaaaaaaaaaaaaaaaaaaaaaaacctggtcgaggaatcctaaaaacctagtcgaggggtcttagggatgacatagggttatagcctcaatctatcacttattaaccatggaactcagcaagttgcctcgccatcagttttctcctccataatatagaggagaggggaaaggaagggctatgatgatcacatgaaattataattaataccacataaattatataaaactatgcagttgtcaacctttcattataacttatgattcaacttaaaatatgtgatccttatggccttaattaagcttagtttcccacaaaagtatgtgtgtttaagtagaaggcaatatttgtggtttttaatcatacttagctgcttgagtgcttaaattgtcatctcttaagaatttcctgtcacatgattaagtttaggttccatgatcccagctgaaagatttccttgttttttggtccaaactagcaggagcactaaatggctaaggtgatatttgaggtctggagctaataatgtaaattatcttgttaggatgttaaatactgaaaatattccttagtttccacaaacactgattgcttttcaaccttgggcacagtataagcagatgacagagggggagcttcaggaatgctactggtaataatagataccatatgaatggagtggccaaacccaaggggccacaccagcttacaagcgccgtatgggctcatttatctacagtggggtttgagcacagctatgatgaataaactccctggtgtatttctttctctttttttcttaattctttttcaaaattagatacctcctcattcagggagagcaagacccgtggtttggatcaacctatcttacatatttgaagagccctggcgccagtactctaagcagttgatttatgctggtcagaccatatccagaatgttatatttggactggggtgggaagggggatgcatattaaggtcattggtaactggaatgtgagcaggactgtgagctctctgcagatgccattgtgaggagctttaagggactgagtggtttcacttggaaaaaggaaagatggtggaagaggggatagaggaacacagtcttggcatttctctataggtttttcaggagctgctgatttggaaagggaattggacttgtttcctgcagctctagtctcttaggtcttagttgccacatttgtacaatcagggattggattgtttttcaaaggtctctctccgggccacagtcctaagactaaccaggtttcatgactgggtggccctggaaggcaggcctctcagagtgagctcctgtttgagaatggaatgtgccaatattgtactctccaaaagaaatttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattttacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtgagtgcttaccatgtgccagacctcacagaaggctttagatcttttcatccaatccttgcatcagtcctgagagattcctgttttataaacgaaaaaacaaaacctacaaggattatataacttgcacaaatccacatggctaatatgcaacaagagtccaagccaagacagatttggctttaaatctgtccgtccccgtcgtccttaagcactagacacactgtagtgggagggaggtgggttccctgtcatgggactggatggttacttatgtctgaggtagaactttggcaatgaattccacaggcctggtgtacagtagaagtccaagggaaacaggctgtgtgagcagtttgtcctccagcaactcttgagcaaataaacattctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatgccatcccccacgtggctgtaattagctgtgggcccacctttgagtctctgtggagtatttagctgtgcattcccagacagcctgtaaatccccagcagcaaagggtcatggggccagaggaaatggttctccaaaggctagggggaagggaggcaaggaagacacattgtgattgttcttttcacacagacttctgataaataggaaatgagaaaaatgatgtttacagatggcttattggattttatcctattttcaaaagtaatatatttgtaattaacttgaagggttttctctgtcatttgggagtagttgcccatatccttcaaaatgtgaaaattttgttctcatttctaaatttcatgctacatgaacatttcctgctagagtttaggaagaaaaattagtcattcagtgatatcatgtaatgactctgaaataactaaagttaaatgcaataacgggactacagtaaaagtgaaacttcagatgtcaattagaccagtgtatgtataatttaaacaaacttttgtctgtgtttccttttcttctttcttttctttctttctatctatctatctagatatctatctgagatggtatctcactctgtcacccaggctggagtgcagtggcacgatttcagcttactgcaacctctgcctcccgggtttaagcaattctcacacttaggcctcctgagcagctggaattacaggcacatgccaccatgcccagctaatttttgtatccttagtagggatggggtttcgccatgttggccagggtggtctggaacttctgaccgcaggtgatccgcccacctcggcctcccaacatgctgggattacaggagtgagccaccgcgcctggcccttttttttctttttagaaggaaagccttttccaataatactgtttccaccttatgtaaaagtgagcaaatttgaccctttagcttttatgttaaaacctttgtacgtaattacataacatgatgcctccctaggaagtggtggccaattgccataaagaacacctatgagagaactacggttttcgtacttccagaagaattttccagctctttactgtttactgagaagctcttctattctcttccacctgaagactggaagaagacctaacaaataggtttctttgttaaccctatttgttagttgctcaggcccttgaacaccatcctcctcgctgctgtgtcagctgacagaccaagcctccacagcccacactgaacgttcgctcccactggtcttcagactctttaatagctttctgatagtaggaaaggtaacagttggtctggctcctaaaggcttatgaggtattaagccagctcagaagtctaggtgctattaaagtcaggaaaggagaatattagatatcattcctgcactctgcagtagcaggccatatcagcagcacttgctccccctgcccatcaaaaagtagtctccgtctaaaaaagaaggaaaagtatttagagaggaaatcttgtgatacacttgtgcccatgttactgacagtataatgctacaacatcaagcacagaaagcccagactttgattatcaagcattcataaactttcaggagccttatagcagacctggtgaatatccgcaagaatgttttattttaaggtattatctttgaagcttcagtattgtatgtgtttgtgcactctcttaggagaaacagatttttgtgcataaggactacagtctgaaagtctgtctctttctctggtttgttaaggaccaagaagctgataattgatgtgatccggaaccagccagggaacacattgacagaaatcttagagacaccagcaactgcgcaacaggtaatttgactttaagtgtaaaataataatagacaggtgttgattttcttcataaatctttatgccatatgtttattatctcagagaaactgtatctgacatggtccggaagtaaggaattttatctattactgcagtggacttagttcagccatatataaacctgtatgaagtatcaatgggaatgaaatagaaaatacagcaccaaattcatgccgaatatacttttgtcttaacctaggatgatagttctgggtttttcaaagcccggaaatgttcatcataatgggcaaataagtcagttgagagagttctagctgacaggatattgaaaaatacctttcacattttatgtatttactaacttgaaacaaataagcgactcacatgttaaagatgttttccaaatgcttcagaagcaaatgttgagtccactgagtcaaagcatcattatgttagcgtaagtgaggtttcacaacaatcttgcatttagctttttattaacatctttgaaaatacgtcattgttcgttctaaaataaattcaaggttgttattttagtaccaataattgccgctccctaaacaaaagttaattatttaattaactatttcttagcacagctacacataattttcctggatcattcttaatttaattgattgccaaggaatccttgtaatagtttttaatttaaaaaatataaaaggctgggcatggtggctcatgtctgtaatcccaatactttggaaggctgaggtgtgtagatcacttgagcccaggagttcaacaccagcctggacaacacagtgagacccccatctctaatttttaaaaatttttaataaaaaatgtaaagcaaaacttcaaatcacacgtttgttaatatgtgggtatgttttaaacaatgtgggtaaaatattatactaggttagtataaaagacttttactccttactatttttcattttcccctaaatgtatcatgaataagtgactaagaacacagacttctgagatcaactatacctctgcacctcctaggtgtgtaactctgtgcacttagaagcattgctgtgccgcagtttcctcaactgtaaaatgggtataataatagtacccagctcacaggcaggattaagtcaattaaacatgttaagtgggtacatctgtatctggtgcacattaagtgctcaacaatgttggctgctgcttttgttatttactgctaacctggtaataatgttccaataatattgacctacctgtcctgtgtctaagattactgtccctaactaatagtcgtttccttagacttcatctattgggtcagtcaattgtctagtacaatgaaatgggaagaccaatagtctctttttgttactgtttccttgaacagactatccaaagagtattcattcattcattcatttactcatcgtttgggaatttataatgtgctagaatattcttattccctttggctcaaagaaactttgcaagtttttcagagttgctggtttgtgattcccttataagaataaagctctctgactgccttactgttggtttagtttaggactctccataaacatggctgatgtgtgagagtttagctgggttctgaacattcagggttctcatagccacatttcaataggtaatctagttttagtttcctcagctagcctatccaggaattgaaatccttccatgtggggaacaaagtagcagttatccattaaaatatgtccattactatagtgatttgtcaccttggcaataaagtagctattgagaatttttcccaaataaggcttgctatcgaaaagatgaagtaattcctttcaaagacctacttcaaaactcaggaagaacatgttctggttctagtctctgaactttggctggaggactactttcattttgacattaacttgcattgtgtagcttatgaactgtgaaattaggggatcagagaaaactcagcatcttgatattctcttttcaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggtttttggaaacagtattctttcttccttcacttagcagacatttgctaatcaccagtcaagtgctgggcactctgtgaggtggcattagggattcatggttgcatatgctgtggttactgccctcttcaatgctacagatttttcaaggtttcaaagcagttgatgactttttttttttttttttttttttgagttggagcctcgctctgttgcccaggctggagtgcagtggcacaatctcgactctctgcaacttccgcctcccaggttcaagcgattctcctgcctcagcctcctgagtagctgggactacaggcacgcaccaccacgcccagctaatttttgtatttttagtagagacggggtttcaccatgctggccaggctggtctcgaaatcctgacccggtgatccaccggggcctcccaagcagttgatgacttttaagagaaaacaatcacaacactttcatgtcattaggagagttgaaacagaccagaaataaatactaaaaaatgtacttgacaagtttggtctatacctttaaagttttaaaaataacactattggaagagttttctcctgagatgttagttgtcatatagctcagttgctcttagaacctgccactgagatggaactctgtgtccctgatcatttgtttttaagcaatttagcctaaatgcagttcagacttgaagattagtttctgttttcttatccaatatttttacacttgagaaacttcctgagcaaaggatctcaacttagtgcaatgaaacatcacaggaagtggctgagatctgtttgtcaaggataaggaagtatatatttgggttagaaggatatttcattctttttattcaaacatgcaaattaatatggatctagaggttaaaggcagttaaatgaccagaaaaaaaaaaaatttctcaccttctggaagggaaatgcgctcagctttgttctttgatagaaaattatgttcaattctggcagtaggcttattccttctagcccaagtgactcaagggaaataacatttctttctttagtttgggggtagaaatatttctatttgggaatatggggtagataaatatatgcttttgctttaaaaaagaaaaaggctatcatgaagacatgatattctatttaatgaatattctattatatgaagaatttctatttaatgaagaattctatttaatgaagaatattctatttaatgaagaaattttacctaagggcatggggaagttgtgggggagtgtatgtgtatgtaggtatttctttgaattcctaggggaatggtttttaacttgtttacaaaagaaaaataatattaaacaggcaccgttttcttaagtcaaacattttcataacttaccaattagaattatgaaaaaaacttatatctgcaagtttaaatttagcatagctcttgtaagctataagcagcttatgcaacttaatgttctaggaattctatttaaatccaagtaatagttatcaatgttgaatcttttcactcagtcttgacagcccagtgttgttttttcaaaccttgggaaatatttgtcagatgaaaaagtttgttcttttcttattttaaaaatgaatttaacaattaaatgtaaacttttttagtttaaagtactattcaaagaggaatattcaaaatagtctgaagaggctgggcacaatgtctcatgcctataatcccagcacttcgggaggccgaggcgggcagatcacttgaggtcaggagttcaagaccagcctgaccaacatggtgaaaccctgtaactactaaaaatacaaaaattagccaggcatattggcacgggcctgcagccccagctactcaggaggctgaggcaggagaatcgcttgaacctggaggtaaaggttgcagagatcaggccactgcactccagcctgggtgacagagcaagactatgtctaaaaaaaaaagtctgaagaaattgcatttctgctactttgtgccccttttaaaacgcaatttttccttaaactaaatgtgtggttattctaaaataacttctttgcctttccatccagagcaaaattaatgttaacaagtctcttaaagtgaaatatgtacactttccagttctgaagtaaaaagggatgggaaccctgtggtgttgagagtaaaataaggtgcctgagataagctacaagtcaagttacaaatagcgacttactactgcttgatattcttcttgtcccaaactggcaatatcataaagcaaacttctgcttaaatatgataccccttacttgttgttttaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaagtaagttaaaatcatgtcatgttcatttgtaatgtcatgatttctatgagatgtcaattctgtgtttctaggcagttgggttgggtatggaagaaaactttttgctctgtcttctaaccgaaaactagagtctcagttttattatttgccactgtgaactaagaagtcaggagtaagtgaaagcttttcaattccccaccagcactagaattaaagtggcttacctgttgtatattgagcaaatagcattagtaagttagggaagcactttcattattccttttgtcttttttagccaaagatttttttaaatactattatttttaaagtctcttgtttttggaatgtattttatataattgataatattagataatgccaggtgtttgctaattgcacagagcagctgaatgtttttaaattgcttcatggttttaaaaaattattgacacaactggcaaaatttggcagctgtctattatccattagcataagtattataggtttttatatacagtatagccatttttaatgaatatcctttgcttagtaattattcttatcactagactatgatcaatgctagttaaattttaattacccatttaaatatgtagtacaatatttttatataatccttgtcatcaaattggcaggaggaaatggtgctgtatggaaaaatctgttgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacattattattagctatattcaccacactgtgcaatagatttcaaaaaaaaactgattcctcctaagatttcatatcctttgaccatcatctccccgtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgtgtgtatatataccacattttctttacctgttcatctgttagtagattcttaggttgatttcataacttagctaacgtgtgagtagtgctgcaatgaagatgggagtgcagacatctctttgacaaactgatttcacatcttggagtaaacacccagaagttggattgctgaaatcacagaagatttgataaagggatgcagccacatttaaaccttattgatttggctcccactagtcctgaattttagttcatttgcttcaggcttctctctgtttctctctctctctctctctctctctctctctctctctctctctctctctctctctcactctcgtgctctctctctctccatatatagttcatttgcttcaggcttctctctgtttctctctctctctctctcactctcactctcgtgctctctctctctccatatatagttcatttgcttcaggcttctttctgtttctctctctctctctctctctctctctctctctctctctctctcactctcgtgctctctctctctccatatatagttcatttgcttcaggcttctttctgtttctctctctctctctctctctctctctctctctctctctcactctcgtgctctctctctctatatatatatatatacaaaaatacactaaatatgtatatacacacactacatatagtgtgcatatgcacttataattacataaacatatacactatacactaaatataggaaggaaggaagaatatatacatatacatgcaaggaagaagttggtcaagcttactttcagtagaaatgagattgttagggatttactttaaggcatttcacacaagatccacagtcgggcgaattggatttgggttctgattctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccgggaggcagaggttgcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctagccacatagtgtttgttaaatagattaaaacagtcctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaaagtgtatattcagcgctctgagggccaggtatgaacagcgatgtcactctgagtatggtaatcgcactaccagaagcctctgcatttgccatcataacaacaaatgttctgttcttattttgtcagaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatagaacacgcatgccatttgatttcttgtggccttggagagagctccatttggtctagcaaggcttaacctcaattactgatgggtgacaagggaagaatacacaaattgttatggctactcttcccttggcctcagcatctggtgctgtcagtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagcacctttctcatttaaaataggctgtgccaacccctggatcagagccatttccaaagcatgctgtgagtgtgtgtattcggtgtagtggaaaaaacaaaccctccttcacagccccacatcaggcaccatgtgctgcctccttttaaaggggtcatgagcccagtgttccatcactttcttgtcctaaaatctcaagggaagccagactcactggcatttgccttttctttaactcctgccttccttcaaagcctgacttctgtttatcccatgaaacctcctgacaacaccaactcagaagaaaatgcttcttccagagatggagtctcactctgcggcccaggctggagtgcagtggtgggatcttggctcactgcaacctccacctcccaggttcaagcgattctcctgcctcagcctcgcgagtagctgggattacaggcacatgccaccgcccagctaatttttgtatttttagtaaagatggggtttcaccatgttggccaggtgatccgcccgcctcggcctctgaaagtgctgggattacaggcgtgagcgactgcgcctggcctgaagtttctataaaagttatcatctgaaatactcaattggctataggtcaataatgttcatgttctgtgactcacatatttccaattatgttttatgctcttgaagagcaaggaccgtatcttctatttcttttgtaataaagcacctatgtcagaactctatgagctacagatctcaacaatagccatcaaacctagtgtttggagagcagaattgggggaaagatgacgtgaggtttttggtgacttccttaggattttctcaacaagccattatttaaaaatgattatttgagattccattagtttgtttcagctttaagcacatctgtatttgtaatttctcatgtatgaatgttcctttcttcacaggtttaagaatgttacatttgatatcatagctactgaagatgtaggcattttcgatgtaagatcaaaattccttggtgttgagatggaaaaggtgcaactcaatattcaggtaagctgctggaatttctgcacattgatgataaattttatatgtggatcatacattgctaccctggctctctctcttcaggacaacaataaagtttaacagaaaaccagtgccagccttatttgccaatatttgttaagtgttgatgatttttaagagctgtgacttttcaaatgattggaaattgatatgcttctagctggcaaaccatagcagtcagtttctctaagccatgtttccattttaaagcttagacaaaagaatataatttaaaagtattcagagctattaaataaatgctataaattttccttttattggaaacttgcatttctttctaagactatgtatgcccaggactggaactttcatgatctcatttttccctctctcctagaatggtttttcttttttgtggggggagggggtgggggtggggcattgagaaggggtcttgctctgtcgcccaggctggaatacagtggcatgtatgcccaggactggaactttcatgatctcatttttccctctttcctagaatggtttttcttttttgtggggggagggggtgggggggggcattgagaaagggtcttgctctgtcgcccaggctggaatacagtggcacaatcatggttcactgcagcctcaacctcctgggctcaagcgatcctcctgcttcagcctctcgagtaactggtactacaggcacacaccaccacatctggctaatttctgtattttttgtagagacagggtttcaccacgttgcccaggcttgtcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaaaaaaaaaaaaagagagcactgcaaacaaatgttcatctgcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtgaattctggcctcactgtctgtgcagcccagggctccatgcactggaattacttccccatcatgggagtgtgtgccagagcccttcttttctggcagcccttgtaagtttaaaagaaaaacgggagctgaatgggtttgataaggacattgagataatggagtaaattagaattcggagataagatgaaagctattatgtaattattgaaagtataattaagtaaacagtattgttttctaacttactttaaatgtcactaaatgtatccatttaataatttagctaattagggtcttcagttattttgtgtaacagataaatacaggaagagaaaagaaggtgcttgtggtgataccctttggttagtgattcctctgtagaaatagcaaaagacatatgtgattgccaagaaggaaattatccagggccagtcaatatcaactggaccaatgagtcacaagtgaccaggagacaccttatattgtgtttagagagaaagcaataattccatgagacttcctttgagtactggtataaaaaccaagcttcacttgttcctttgttaaggattctgtatacagtaagattagctgttcataccattcatttatacacataatggattgtgaaatgttaatccttagctatatgcaggtgaccagtatgtcctgggttttttaaatcagtagtgcataatcagaactggctacatccttagcagggctcagagcaaaataaaaatgcagtgccctgtttttaaaattattaaggattttaggatgatgacagaagagaataaaaccctgggcatgggaccctgtgcggctgcacagattgcatacccacggagccagccctgcatttgatagctgtcagatgtaaaggcagacttctatttatatatgcagctttcagtcaattgcatgaatgtgtaaattgtcaaagagaaatgtgatggccaggtccttactgtgagtaaaggaccaggaacaggaccaaagtttgaaaggactaaagaaagccccttctaacattacagctctatgtctcttggttatcttcagcccattttcccttcagttcctaaagaaaaccataggatagaattatatcctataattataggccatataggtaacaggaggatatgacttatgtgatatatattcttcttgtaaaaataatgtcaggtatttatcggggactgcagggtgggccttcttcctctcctagatgaagaactgaggttcagacagctaattatggaagataattagctgggataattatggaagataatgcagctgggatccaagttcttcatcactctagtccactgcctgtctcataggattccagttgatcctgcaagacaagagtagcttacaaagggtttgcatataccttaatctcatatctcattcccagtagcacccttgtgaaattggcagtgttatccccaatttacacacagggaaacagaacttcagagaagttatgtcatgttgcaaggtcttaagatagcaaatggcagagctaaaactaaagtctgcttttcaagtcatgagtccagccatgttttctctgctccctactttggggacccagctacttcccctacatatgccattccttttcaatctaactctattggtttaattcttttccactagactttgtttaacagatgttgcatttcccagaggaaaagtgaatctcctctacactctaaatagctaaaagtattattgatgaaaggacttcaattccctatagaattttagttctagaagcatatctgaataatgtaggggttttcttaagtgcagtgagaggtaattgaggaagtggaggaggaagctgccaagagtcagagttctctcaaagatgactccaacttctacaattgaccttgctagaaacaagaaaatgagacttagatattgggccaggacagctcaggaattatatcttccattgggaaaggcttcctgtacctatgttactatgaaatgttacagcttagtttcatgcatatggctggtgtgatccagttacttattttaaaaagagagttgatttcctttgtttatatgctggcagtgaaaaacagaatgacagttcgacttaagaatgagggcttgttctcagtacagaaacagaagtagcctagttcaagaagtgcggaccaccgctttgtacaatggtctccaaactttggtcacttcatcaggaaatagtatgagcacttctctccatacatagttatttgtaaagtatacatgcttctgctattgtactctaaaacgtgctgtattatataccaaaaaagtccaaaaaatgagaaaaaataaatagaaataggagttctaatattctttttgcttccccagtgaatgtcttgctcacttcactttaaaaaaacactgctttctgtgtttttgtttttgtttttgtttttgtttttgtttttcgggttttttgagacagagtctttctctgtcgctgaggctggagtacagcagtgcaatctcggctcgctgcaatctctgcctactctgttcaagtgattttcctgcctcagcctcctgagtagctgggattacaagtgtgcaccaccacgcccagctaatttttgtatttttagtagagatggggtttcgccatgttggccaggctggtctcactctcctgacctcaagtgatccacctgcctcagcctctcaaactgctggtattacaggaatgagccaccacacccagccagaaaacactgctttctaaagaatatgcatctagccagaactttgtgttttaacattttcgattaaaaattgaaattatatatctgacattaacttaatgatcatcatttactttcatacagcccttatcaattccaaaaagctattttctttcatctaagtcacaatcacttgggaatttattaaaatgcaaattgatgggccccaccagagagctacataacaagaaattcctgtgggaggagcccaggcagcctttattttaactagcctatgtttttaaccagatgattctgatgtacacttaagttttagaacccccatctatggcctggtgccatggcatgcgcctgtagtcctggctactcgggaggctgaggtgggaagatagcttaagccaggagtttgagaccaacctgggcaacatagttagaccccacccaggtgattaggtcaattgaatctgacttttgtcaacaaattcttctaatatgttttttaaatgcacaaaatgtcaaagttgagatttaatgatgctttttacaatttcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaa

SEQ ID NO: 243 - DNA, 349329 bp, Homo sapiens
agcagtgcattaattattttattaatttcttctttttacattatgggaaacattcatctatttacaatatttttttgttcacacacaatctaggtaaataagcctatgaaattccaattcataaagccataaaaatgttcccacccctccatctgaaggctttcaaatgaatcttttttttccaaaccaaaataatttttaaaaattacatttgggaattcagatatgctagtgatttacattccagttatttaaaatatgcatctagacatgttttaaaaaagaaatggtaaattcacaaggataaggcttaaatgaaagtggtaatgcacagtaaaacattaaggaaacatctataaataacagaaatatattacaataaattagttctatttaccatttcaaatattaaaaatctttaatccatttcttcatctctctttacaaaaaggttatgtgaattgtatggaaacatctgcaaaaaatataataaatacttaatttctttgaacgttttttgatgtgggagacaaacttcttttgtaatccccccctccccaagaaaatgcccaacacctttataccaaagttaaacaaaataagtaatttttcagggtacatacattttccattacgaactaaaaaacatttctacaaattacatcaaaaagaacaatgtaacaaaggttatgctcatgaatgtcagtttcaggggtcaagcagcattgtgtggggtcatgttctaacaccaataattagctttttataaagtgtttgtacaatttaaattgtattttcaaggaaggcaaagatcatgatgccctgtaggccttgagctaaaagatttaaaattcttaccaaaaatagcttatgaatatacaaatgccgttcacttagacaagataaataggccttctcttgtctctctttaaaatatcatgggctaaattagtttccaaagaaaatattgtaggatgatcttgagtcgtattagaaatctatttcttaatccaaatctcaactctacctcagggcacggagctgtaattgtgagcatgggtcttgggatgaacgctgcttctttcatattaatctgtgagttccaagtcattctcagtattgaatgtgaccataggctacccaagtggcagttggccctactcgatgcaagctttgtgtgacttttaattgctgctacaaggtaaagaaaaggtgtattctttttaaaactagcaaatacttgaagctcaaaatctctgtatgctccaatttcacaaagcactttgagtgctttgttcaccctagttaaaagttggttcgttggtttcaaaataagtgagtagcccttttcttgtaaaccacagcagtaaacatttgtgccctgtttataaaggtagctcaaagcatcgatggctctgagaggtagcgaattctctagtggttttagaatatgtccgtgaaaatatctgttgctagaacccatcacctctcttaatttcataagtaaaattaaattagcacctggctatgagagtgtattattttaaaaagcttctctggtgcaagcatgtttgatgtatgtttttaaaagtctttcgtttttaatttctaatgctttaggatgttagctggacataaaatgccattgatacttaagattgccacatcctaagtgtttaaactgtgacgagtaagggcatttaaagacaacttcagctagacaccgatgcatactgcccatcaatcaagactaaaaatctaaatcaacactctctgccaaaagccttgacttctttcagtgtttatgaatcatgactccccccacctcttcatggctgttgaccctggcaggtcgagtttcttctctcactacctggaacctcaagatgacagcggcagctcttttgaatgaggcagcatgtctattggggcaaaaatttattttagccatttgacacaggacagaatcctatgctaggtattactggactctgcagtagtgagaggagatgaaaggagaaaatatatctgaaatacgaactacttgggttaaaatagacggatgtgtagcattcaaagggatggtaggaaaacccaaactcttctccaaaaacagccttgctgccatttacagcgctttataagcagatatgtacttatatatgtggaatcaggtaggcccacctggatggacacttaacaaattaatagaaccaacactttccctttaaaaacagccgccacgacaacaatataaatatacacagtacaataagagttgagaaaacatttcaggtctagattttcttaataatagaacaaaaaaatcccttatgtagtatactaaaccatcagtgcctcctttgccttgcttcatgttattgcctttcagaatagattaatttccctgaaagatcgaatttacaatcttctgctgattgagacatttgaagctgtgattgatgaagtaacagtgaggcagtttgtgcagctgtgagtgtgcaggtgcccccagcacctgcagatttcgcttctcccatccttgctacacatccaggtcccccacccccaggccaggcttggtcccctctctctgtgtccctcatggattccagtgagatggtgtgatttctgaggttgggaataaagtgctccatctgcttttttaaaagaataaccatttaggggaaataaagggaatcggaggcctagtttctttcacgtggaagacggtaagtcccaaaggatcaccctgtgatactggatttctgaaataccctatggttttatattgctgaacagactagctcgagagaactgaggacggcgggtgacctaaaggcatcacttctacacaggtgggtttggctttgcccagaaaataaagggttggatctcagtatgaggcagggcgacggcatcaggacagggggcgaagctcggtgaagaaggagatgggcaaacgggtacgggaagtggggggctgaggggggcccggggggcggctcctgcgaggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcactggaggaggggcccttctctcctgatcaaagcagaaggttcaggacattacacagcttctcaggacaagcttgggaaaaactgggataggtcagtagttagaacacacagttttttacctaggggtggttagttctgatctgcacactgcatatctacttttttcttcattattctggcttgggcattcaaaagatgcagaaaaaaaaaaatcccggtaagcttaaggcccagggtaaggctgggttgcagaactaggtctctccaagggaaggaagtgggtattttaaaggccccctgcggaaagcctgcggctcccagcacattgagtgcggttctctctggagactccagactcctcctggtgccagagatgggccaggaagcagcggctgcagcagcatcttagaacccctgcatcccctctaaggatgcaagtcaccgggtgcaagcttggttcagagcttaaaaacatctccgctctgtccccggcccgcccaccgtccccttcccaccaaacctaaataaacagaggaggaagaagagatatcagattgtgttctttagctttgttggtgctacaccaggttagacccttttgcacaccacacacgaacacacaagcaatatacaatatacagggtcacgggagagggaggccattgatatttcctacactcgagagttaattaagtcagttccaaggtgactctgactaggggcctcgggataactgtggtggcccaggaagcaattccaatcacaggggcagaaactgtgccatgaaaagttgacacaggatgaaagaggtcattcctcttatcagcagcaaactatgaaatgggcggatattttcaatgccactgcaaaaacaaaagacagtcatctctttggcattaaaaaaaatgcagcaggaaagaatggcgtctagaccacaaaggatttttaggcaaagaaggttgaagttgtagactgtgaaagggtgcacataaaactgatgttttcattttaaataaaataccctccattctcataaaatgaagcgtgaacattatcttaaaatatagtttcggtgattctccaaagagtactctttgtatcttaacaccaatgctcagcacagcaattcctccctgcttgccagagcaagtgcctagttcaacttctcaccctggagctaccccaccggctgtctaaggtggagtctgtgtggcttaaaagagaaaaaaggagagcctggagtgcaaactatattctcccaactctgattgtgcttgttcatttttctcctcaggttcatggggtgatgaaaagctctgatcacaggcaaagtccattaaaaaccgtaaaaatcaagctaactaatgatttactatgtaaatatcaataggttacatatatcaattcttagcatctcttcttttagacattttaaatcttcattgtggaataactcagtggatatttttagaaatatgaatattggatattttttagtcattttcctttccttatacatttggattttttaaacaatgattactattattattattattgagacaagctctcgctctgtcacccaggctggagtgcagtggcgcaaccacggctcactgcagactcaaactctccgagttcaagcaatcctcccacctcagcctcccaagtagctggcactacaagtgtgtaccaccacgcccagctaatttttgtactttttgtagagacggcgtttcaccatattgttgcccaggctggttttgaactcctggactcaagtgatccacccgcctcagcctcccaaagtgctgggattacagacatgagccaccatgcccagccaacaatgattatttaaaaaaaaaaaaaaaaaattagatgcatcagctctggaaactaaattaccagtatgtgtgcatttgtagtgttttcttaaaataagactgatttaaagcttatctagcagatagttttaaacacagattaaagaaaactagattgggtacaaatgtttggcttcccaagtgagaggccacatgtacatcaacagtactttccaacttaacactacgacccccattttgatggtgacagaattggaaacgggggacagtgatgagagcatcaccctcctgtcacttacagatggtcccttgggactggatttttcctgggagaccattgaccccaagaaccctgaaaacatgatatgcggtagcagaatggattagattgctgttagctttctggtaggtgaggggacctgaaaagaacagggccaccagcatttcaagggaacagccattccaattttcagaggttgattctcttggaattatttgacctgaggccataggaaagcaaagggttaaaaaagtcacgtttgacatgccagcctggggagctggacattggatacccgtgtgagcctcgtggaacaccataatcaaatgtgaaaattagagttgattaattaaagtaaaagaatttaagtctttatttctaaactgatgcatgaggaccccagtgagcaatattccccaaggcaaatcaaccaaaagcaaaactgttttgaaaaaaaaaaaaaaaaaaaacccaacatttatgtaattactgtgaaactttatggtatatatttttagacttgaacaacagtaatttctttattactatatttatgaaatgattatcaaagtcagttatttttcagggcatcctatttttcttgaaaacacatcctaggggtgtaaggaagttgaactcttgttctatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactcccatgaccatgctgatatgttatgaatatctctttttgttataactaggcctttttgtcttccattcctttgcataaagaatattacccattcaactagggaagtggttgtataaattatagtacaggaatataatggaatactttgccattgttaaaaagagtgtggttaacccacaagcatttatataaaacaatgtttaagacctaatttcaagtgaaaagagcaaattgtagaacagtatgtataaagaaagtttagacatgggtatatataatatatgcttagaacatttctgaaaagattcataagaaacagaattcttacctctatggagggctaaaaagggaatgaagaggggagggggactttaacacattattaaaatatttcttggtggtgttaaaatttttatgagtattatattttgtaataataaaaaaggaaatcttcccattatttctaaataaaaaagagacatgtgggtatggtgtatattggagaatggcgtatcactacggcaagcaagacaaaataatagcagcagcaacaaggagatctgacctgtggtattaggctgtttttgggtcactagaaagaaatacttgaagctgggtaatttataaagaaaagggttttaatcagctcatgattctgcagggtttataggaagcacggtgctggtagctgcttctggtgagtcttcaggaagcttacaatcatggctgaagatgacagggtgtcagcatgacacacggtgagagcaagggagcaagagggtggggaggtgccacactcttgaacaaccagatcttgcgtgaactcaaagtgagaacccagtcgtgttgatgaggacggcaccaagccattcattagggatccgcccccaagacccaaacaccttccaccaggccccacctccaacactggggattacatttcaacatgggatttggaggggacaaacacccaaactataccacctgtccttggttggcttttgatttttggtgtccttatttatctgtgtaacttcgtatatcagccctttccggtaccatcctaatctctgcttctaccattctttccctgcagcagtacaactttctcttgtctcttacttgatttcaaactgtctccaatttgtctctctctatctcatctagaggcaggctagtatagtggttgataacatgggctctgaattcaaatcccgactgtgacacttctagctctgtgaccttggaaagtcaattaaatttatgtgccccagtttcctccttgtataacctagttaataatgattcttgtcttataggtactattagttattatgtgaattgtgtctggcacagaggaagtgcttctaagtgttagtcattactattcttcaaggtgattttttggggggttaaaattagatatatttcaacaagaaaaacaaataaagaagccaaaagaaaaaagtaagagaaaagcacaagaaatgcagcaaaaaccacccagaaagcctcttcacgagaagaatgactgctgagatgttagaagatatccttccatacatatatactcatgtaaataatatagaatatactttcatctaaataagaaaaaaaatctctcttgtaattggctttttgactccacgccacgcaggccatctgtgtttttgtttgtttgtttgtttgtttgtttgtttttttgagatggagtcttgctctgtcacccaggctggagtgcagtggcgtgatcttggctcactgtaacctctgcctcccaggttcaagtgattattctgcctcagcctcccaagtagctgggactacaggtgtgtgccaccatgcctggctaatttttgtatttttagtagagatggggtttcaccatattggccaggctggtcttgaactcctgactttgtgatccgcccgcctcggcctcccaaagtgttgggattacaggcatgagccaccgaccccgccacgcaggccatctttctaaaacaacacttacatcacttcattatctggctcggctatcagtggtttcctattgctcactttattaaaacaaaatgaattctctggatatgtaaggatcttacttagaaaagtcctcactttctatccaaagatggcttcccatttttaaatactcttctaatacatcagtcagcttaatttctttatactcagacaaaattcctcctccgtagtctgttgcctctcagtgattattcagattccaaatcgaatcctttctctttcatgaagtcatcccttcctattttcaattcctattagtttttcttttttttggacaaatatagcacttttagttagcggtaacatacataatgtaatttcaaaacttacaaataatgatacaaaattgttttcattgctcttggcggcactgaatcgtatatgtgcagtggagacagagccttatagctctcttgtctccctcagggcatttagcagcttgaaaactttgattcctctggaaagaagtcttggttgagagtgagatgacttgggtcctaaaccttgctgaagagcttaagcgaggcacctctttacttggggcctccatatcctcatttgcaatataaaagggttggaatcatctttgaggatccttttagttttgcttctaagattttttattcattctctctctgaagaaaggctacctaaaaataatgccattggtaaagtggtaaatgtttagaaactgactttttgggaggaagaagctctgcctcgtagagcgtgtcgatttccatggtgtaaatatttccatcacggccaatatcaggctcccaggatgacaaaactgaatatggagttgggaagagatgtccaccattggctctcattggacgactggaccccccctagcattgtggagtggctcctttcaatgaagaaatgcagcctcaggctagatgagcacagccagctagcttcgtctccagcttctctcactctaaaactccaacacaatctttcttcactgagtggagaaggcgacgacaatggaaagtgctcccagcttggcttttcaaacccaggctctgaaggcacaaaccccaggaggaggccagtcttctcaggcacttgtacccacagcagtgtccatctcttttggaatctggcacaggaatgatgctaccgaggtggtggcaattttatatgcagttggtaatttggatctgttccgagagctctcagctctgccttttctgggaaagaggtgtggtccaaagaactaaaagaaggttctgagctgtaagtcaagaacaatgtacagatggtggaaacagtctccagactgttcagggaaaagtcctcagagtttcatgagtcagtgggaggaaagaagttggagagaaagtagagggctggagccgaagacccaggctctgcctcgtgaggctcacaaccatgagaaagccttggtgtatcagtaaagtgttggttaaaaatcaactcgaaattccttctgacaccgttgggaggatcttatcatatgtactaaaaacatttgatgactgttatttatacttatttatgttaaacaataggaagaaaattaaaatattactagctatcaggatagatgatattttctcttcattggtttatgtaggttcatatatatatatatatatatatatatatatatatatatatatatataattttttttgagacagtctggctctgtcggccaggctagggtacagtggcaagatcttggttcactgcaacctctgcctcccgagttcaagtgactcagcctcctgagtagctgggatcacaggcgcacgccaccacacccagctaatgtttgtatttttagtagaaatggggttttgccatattggtcaggctggtcttgagctcctggcctcaagtgatctgcctgccctggcctcccaaagtgctgggattacaggcatgggccaccaagcccagccacagataatttttaaagaatgttgcagtagttaatgtgatcattgaagaacacccttcccaacttcaaaaggactagttaatgctggtgctccctgccccctcatagaactagaaggaactgggattccccagatgaactgaaggaaatacgctaatattcaaagtggataacaatactagggatggctgcgtggatatttttaacatgctaatgtgtacctgccagactgagctcccagcctccaggtgggctggcaatgcaaagtagggttgagaaggaacagggagcttttcagagaaccacagattcagaagcagagggagggggaagaattgaagagaacacagacgcagtgaaaggatgctgggcagatgttagatggcagctcaactcaaccactgcgcattaaagttactcatggagggtactgttcagggcactttaggcatagagggattgtgtaatgatgcgttagcatttgttcaacatcccctctgggatgacgactctgtgccaagtgcttcaaaaacattctttcagatagcattgaatctcttcctacacgagggacagagaaaataaaccagtgcttaagaaagctatattaccttgagaaatgttaacacagtgcttcgggaattcttaggaggaagaaataatggctgacagccagaggttaaatttgagaagaagatttaaaagaatggagactttcttctcatcttctcccccattagatcgcaagttctgttgtactgggaatcctgactactataatatatcccaatgcttagcacatagtaggtggccaaaactgataataatgatggcgatagctaacatatgtggagcaactactgtgtgccagggactgtgctaagtgcgccacatacactgcaccttctcgaatctgcataattacccttgaacaaccagtggcttgttgaagtggcgtgatgttacttcccatacaagtgttctgtgcttgtaagggaatagcaggaaagaagatctcaaaggagaatggtgtcttactgtgacacttttgaatgttacatttggaactttgtgcctagacaacatgggattcagagataattttttagcaacctggtagaaagtcttagagaaggagttggagcagagagaggctgggggcgtcaatacaaattggtccattgcaatcactcaagtgaaaaatagtaaagctggaagaggtaagaggtgagttgcaaagtttcaagactgtatttaaaaaatggtcattccactgatagaaagggaagtgtcaggaagagaagtgatatatttagggagtactgtgttatgtgggtgctttgaaatctcttcttcctgaatgctgagcttgaaaatacaggatcaatgcacatgatcagacgatggtgcagatcttatgctaaagtcttagactctttaggctgtaaagatcttatatagatattttgtctgtcttgctcaggcagaattatcaaaggtctcagaggaatataactcagcttgtttcaaaagaggccttggaagttttctctaacaatttccaaattaattgatgtgataattaataactttgcacttagaagttcctccttgcagctaacctgaattccttgggctgcaattttgatctcatttcctcctggtttatagataggaatgttgatgatgttgctatttcaaatgcatcttctgtaaagatacatttatttaggacttacacccagcttgcttctaaaaaggattagaggcagctcctaatatgtccacctaggcttccttttaaagaagcttttctcattcctgcaaaatgtcttccatctgcatgcataagaagaatttctttaataataaatgatacagcaaaagtaaagctaataacgaactatgctgacaaaatagtaacctgtaaacaaaacaaaacaaaaacaaaaagaaacaaaaaaccacaatcctttcttatgccaggcaatgcagatttttctcatcagaaaataattttgaccaaaactatcaattttaacaccgccagcctctgaattttaagttcctttcttctttgtagtgcctgcttttgccattcttagactcgtgtgtgtgtatgtgtctgtgtgtatttttctcttccacttgactctggaaaaccagattttagtaaagcatttagtgaatattgaaaccaaggtataaatgatggacacagtacttaaattattaaaggtaccaaatgtttgttgcatgaataaatgagtgagtgagtgattgcatgaatataatttgtgattgtaattagggtgttctctttacctcgttgtctgcactttaacgggaacatagatattaaattgaataaatggcaggtggcagacagaaaagacgaaggaattttgaggctctctgcaaagagaagccgtcctggaaggacagtgggcagcatctctgatcagcactacctaaaggaagtgaggagtctttgttgccagaaaccttagccagggccttccctgctcccctccctctgctgtcttagggctttgtttacacagccccttgaagccagctgtcaagggtgcaaacctggtctgccatcctttgaagaaggttcaggttacacatggtaagccacagaacagagaaggcccaggattcattattgtattagtctccacagagctgaacccaggctcctaagagtccgtcccttcttcctgtgtcctctgtcagccagcgccttctgcagctctgatcctttggtcattggtccttctttcctgcacctgaggctaagcctgagtcaagatgttctcaagatccttcctgtttcagctgcatgtctgatgtttacacttgcgactcagaactcacttcactgcaggcttctgacgccccttcaaatccatgcttcactctcacaatctgttttgaatgtctgtttttcctgggtaccacttctcagttgtccacacccagttgatcttcctttcccctccattattaaacatcttttaaatagctcatcactgcagtcttagtaagttcaactttccgtccagctttttatcttttctggtttcaacacctgggctcaaatcttagctctgacatttgattgataggtaaccttaaaaaagttatttaatctctctgagatggaaatttgtcatttgtaaaatgggcaaaattgcatgcatagagttctgatgatcaaaagaaaacacgtatgtaaagcccgtagcactcagtcaggcacttagaaccttgttaaaatgtaaatatccctcctacttaaaaaaaaattattttaagttttgggatacgtgtacaggatgtgcaggtttgttacataggtaaacgtgtgctctggtggtttgctgcacctatcaacccatcacctaggtattaagcccagcatgcattagctatttatcctgatgctctctccctcccccaatccctgactcttaacttttaaaaatgtctcattccttctctctagaaaagtatcgggactttcttttattcttttgcctcctttaaaggcacacaaggagttctctcctctctatagtcatgatcattgtagagacttttcagtctacgcaggcttcctttcaacacaggcttcctttcaacacaggcttttctaaagagtaattatatagcaagaaaccaggatttggtacagactacaatactcacacatgcccacatcatttggaggagggcattcatatcccaatgaaggaacatttttttaaaaactaggagtggtgatctgggactcaatgtaataggcgattgcttgtattagctgtttttttcttttttaaataaagctgatttctaacaaatatttgaaaggtatttagataatttgtagatgagcaagtgataatttttctgtgagcaagaatgactttccctgttttaaacgtgtcgcgtttcttattatattggaaagtgggagtggggagttagaagtatagaggataatagaagaaagtattatagtcaggtcgcgtttcttattatattggaaagtgggagtggggagttagaagtatagaggataatagaagaaagtattatagtcagggaagaatgggacactaccctgggtttatatcactgatcactgaggacgtaaattcacaatttcgtgtggcaggttgtattttcttgttctccctactttgtgaggagcatttgctattatacgttacaatgatacggaggaacaggtaggagaggaacaaaaaagcatttaggcaaaacagagacatttcatactacttagaacagagatgggatgatacaaattgctatgttcccaatacagttcatatctttggggaaaaaatagcgatgctccaatcttcatcccatccccctctttctctaacaagaaaaggaaaacgaggagcagtaggtaggtaggaggggagtgtatgacgtgaggaacaggcaaggacacagcatgtccaggaggagaaaaggggagcaaaaaacgtatacaagataaacaacaacaacaacaaaagagactccagcaagaggctatggttttgggctcctcacgtagaaatcaatgcatttaaaatatccagaattaaagttgaagaagaacactccatctacctcttctcaaattattttctttaccaatactacttccttttgtctttaaactgtgaaccactactctactgtgccttgttcttacaattatacacgtcagtgctgaaaggttcctgggagacatttcctgtagactaaggatagcacctgtgggcatctcggatcgatgaatcatggtggctggagcactgcattgagactggttcaggggctcagtctgttctcaatgggtagggtgatggaatccatcaatgctgggattggctaatgctgtcttccacaggtttggggtgggaggagttgtagggagagccgcccaagtggtgccatccacgctaagagactgagactctcatttacgaggaggttcagagacattaatcaatttgccaaaaggcacacagctacttagtatttttccaaatttaaatttaaatttttccaatttatctaaaacaaacaaacaaacaaaggttcagggccagggggaaaaatgaagattaagaggattaaccatcctgaaaatgaaaaatgatttgccttcaaggcatttagaactgaaaataaatcttcctgaagccttttgttagacactttatcaaaattgctaggagctctgactggctctcttgcaacagcctggaatccttctccccagtttcagaggagtttcaaaatctgtaatattatagactgactatttcttccagggggagaatttttcttagtgcttggataaagagatgaagtattaagacactttaaactattattcatgtaggattaacagatatttgaatttaacttcagaatcttttaaatgacaccccacttaatataatttttaaaaagttctttctgcagtgtatcaaataaaagtcccagatgggatttggacttggttttaactaatcatggtagcaggcagtagtctcagttctagaataaatggcactccaagtaagagacttaagttcttcatcagtgccaggctgcaacaacatgctttgagggaactctggcccctaaatgtctcctctacttgcctggaaatttactattaaacattcagaatttttttgaaaatgctaatattcttgggtgatacgccatttcaaatttattgttagctaataagtaaggaagaaggaaaagctagtgatgaggtggagtgatttgttaatagctgtgggataagagaagagagtgaccgaaataatagttttccaagagtagctacaggaggggttttgctggcccaaagatggacttcattgtctcaaaactactcctaacaccagaatgtttaactgaccttaggccttatatgtctgaggacccaataactaacactaagcagctgatgaaaaaccacccacataaataaaccctcaagatgccttcggaaaatagaaaagaaaagagaaaaacaatgtaagaaagtgtaggagtgccttctcttcaacatttctgagagaagatgggagttgaaaaccttaaacaaaatgttgccccaatctcacttgcctaattttagttatcttggttcagggctatgattcatccctaaagctgtgaattactgaggaggaaggagggaaaaaaaaatcgacttaaatgtcaaagaagtaggaacataaatatagttttcttttttgaggaactagaattccaggatatagggatcttttttctcataagggactgaatccttcaaacttctagaaaaataatgatctgcagtcaaaacatcatcaaggaatgaaagacagaattgattatgagtcatgtcatgtctgaatttttgcctctatagtgtattttcctttttttcttttgtatctctttcaatctggttaaactattaattaattaattaattttgagacagggtctctctctgttgcccaggctggggtgcaatggctcaatcatggctcactgcagccttgacttcctgggttcaaatgatcctcccacctcagcctcccgagtagctgggactacaggtgcacgccgccacacccagctaatttttgtagtttttgtagagacaaggttttgccatgttgcccaggctggtctcgaactcctgggcccaagcaatctgcccaccttggcctcccaaagtgctgggattacaggtgtaagccaccgtgccaggccaatctggttaaactagaggtcactaacaattgtatgcagttgaagatgacggaggtttaatgtgtagactgtaatgacaaagggaactcataaaataggtgagtgtgaaacgaatggaggtaagtggaactatgagaaatgattctaggggatgtgatggtagcacagggaaggaagatatgtttgaatggttgtctaaggttctcttgtgatccttttgtggatcataatcataatgattgagttttcacagtaatatatgagatgtgcttccttcaaaccttgttatgatgttggcacactatccgtcttacataaacataggaaaaaaaagttctctttcctgccaaagaacaggggacaacagaaatggtgtggggaaactccatcctaagtaaaatgttttcaatttagtaggtgttctcctgtccatttatcaccactttgaatttctgtaagtggggagggatgaaatagcagtcactaactcatacccagttcaacaacttcaccgtctgaaggagctgaccctctaccatcagcctagctgtcatctgcatgtttgcctctttctgctctgaaaacttctgagcagtaaaagaaatatatggtggtcacaaaaatacggtccaggacgttggaggagggtcatattgtgaagaaggcaaatgagaaagaaagagtttcaatgacttcagagtgatcctccacatcctgaagctatgagagtagcccagggcacaattgtgacattgatttcagcccctaccctctagccctgtcctcagtctcctcagagcactcttctcatcttcctcatggctctacatctttctgttctcctcttacctgggtattgctgtggacaagagcaattcctctatcttatcacccaagacccaaagtgtcactcagtgaatgtgaccaatgcatcttgatgacaacctaacgggatacttaggaggtggaaaggactctggaggttgccggtttaagtgactttcttgcccattgcaatccttttcttgcatcttctggaagatgttaaccctatggccatgactacctaacattgtgtctagtggagagatattttaaggtccatagaagaatttttttttcagaagggtccttggcctccctcatttcatgtcaccttggtccactgcctttcttacaaatccagttcttctaatttaattttctgagcttctgctaggcgcgccaaagtgcaatgaagacttgtttctgttttttatttccacgaatttttttttttttttaccttgtgtggcaatgttttgggtccaattctgttctccaaatagatatattgaagtcctaactcctactatcggtgaatgtgaccttatctggaaatagagtctttgtagatctaatcaagccaccaagtttgtggtagtttgttctgatgattcttgaaaagtaacacatgtagtaataaaggcaaagaggaagggcaactggaagccaaagaaagaaggaagaggtttttttcttggcttaatttactgatgcactggtattaatttttgattaaaatgatccagaattgttccacatgaacccttgaaaaataattcatgggaggccgtctctgtccggatctttaaaatacaacatactctgctatttaaataaattcccatcgcacaatagtcagctgtttttcagtgctcttgattaacaattgggtttgttttccttaactcgactgctttgattttttgttttattttgccttttaatattttatttagtaacataaatgcatgaatagtaatgttcatttcatcaaaatatggaatcaaaggcacttaaaaatacgaattatccgtaatatatttttcaggtccaaatggaattctatctatttctacattccaagactctaaagaatttactctctataaacagcatttagaatgaaatcaggtcttgcttaaaataatcaatctcagtggtttcctgcgtagcgctattctttgtttacaaacagcacaaatacagttaaggactacagtcatatgctgcacaacgacatttcagttaatgatgcatataatatggttgtcccataagattataatactgtgtttttactgtatttttctatgtttggatatatttacataaacaaatacttaccattgtgtgagagtcgcccacagcattcagtacagtaatttgctgtataggtttgcaacttaggagcaataggccactccatatagcctaagtgtgtaataggctagaccatctaagtttttgtaagtgtactctatgatgtgtgcacagtgaaatcgcttaatgatgcatttctcagaatgtagctccgtccttaaatgatgtatgactatatttatatttgcaaaacaaaacctttttaaggccttcaattgtaatacatatcgagtgcccaaatttaaaaatgtatgtcaagaaccttcacatatccaattttaaagcacggtcacactctataagcttctctaagacaatctcttctattatgttactcaattatctgaaaaattcaagagtcttaagaaaaagttcttgtgtgtacttcgtgcctgagcaaacgttcaagaattgggatacatgtatattctcattgaccagaaatttcaatccttttcagaagccattctggattcttttaaatccagaatggcttctgaaaagatgggatttcttctgcttcttagagatgaggggttcagcttatgatcaatgcagaacacatctgttgcctctctctacaaagggactggggtacggacgtcagatctaaagtcacaatcaatgtactgcactgctccacctgtaggatgtttctgccccacttactctaggagacacaccatctgagcctcggtgataatacaagcacctggactatcgcaagtgcagggttaggactactcacttgagtgtggtgagttctgtaagggatggctgagtagccttgagatagctttctctccgcgcagcaacttttggagaaggcttaggactcgtgtctgagtctccactgtcttcatcccccatggccttgatataactgccactccgcattcttcggcatggaatttcatcatctttacctcgtggggtgtaccctgtccattcatcttgtggaacctattcagatagaaaacagataaatcactttttataaaagcctacctttttcttttctttttctttttttttagatttaacatttctattttttttttttttttttgagatggggtcttgctttgtcgcccagactggagtgcagtggtgcaatcttggctcactgcaagctctgcttcctgggttcatgccgttctcctgcctcagcctcctgagtagctgggactacaggcacctgccaccacgcctggctaattatttgtattttcagtagagacggggtttcaccgtgttagccaggatggtcttaatctcctgacctcgtgatctgcccgcctcggcctcccaaagtgctgggattacaggctaacatttctaatttttatgagtacgtagtaagtgtatatatttatagagtacatgagctattttgatacaagcatacgatgtgtaataatcacatcagggtaaatggggtatccatcacctcaagcatttgtcatttctttgtgttacaaacattccaattatcgtcttagttatttaaaaatgtataaataagaccaagtattttctttttttggtatggtgctggatattggtaatataattatctgaaactttagacattaacctttcaataacaatattttattgtaataggctcataaatattttgaatatgtacaaatccacgtctctcagtctttaacatgactcatgtagtaggaaaaattaaaaccattggctttgaatcatttgtacatctcagttttctcatgctgataatagttgagtcaggcataagaatgccatttgaaaggagagcaattttatttgagcttttcagtgatttgttttcaattgccatttaagattcgggaatgtttactgattgatctatgccttccttgaacctttcgactttaccatctcatatccagtctgtcttcttcctaaaccagtggtctctaccagctgcatttactccccagtcacttattctttctgaatctttcttaatttggattcagcttccttagatctgcttaaagcactctctaaaggtttccaatgatctcctaatggaagataatggcattttcttgcttttattttttcttggcctctgcacacccgtgcacacacatacacacaaataacacctctttgcaagtttctccccttttggccttctgattgcttgacttacctggtgtagctactacttgtctgaattgttcctttccttttgctttgctggatcctactctaagtccctaactgtggataccacaacaaaatcatattgtcagtgcactgctcttcttttttctttccacagtcattttttctgagttcagcagagcactgcactacgttttagaagccatcttcatgactttctcttcagttcctcttagattttccacttcaacatgaactcaacctagatctcattccttcttcatttttcatgacgtgaaaaaaaatgcataataaccactctttttattcattaagaagtaacatagcaaacatactatagtggacagagcactgcacaaggcttaagtaaaagagaccaaaaaacggggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcatttattaattatgctagtaacaatgtaatgtttttacttttgtaggtaaaagcatcaaaatcaccacagcaacaaagatttctcaggaaattataaatgctgagaacagtcttgttttccttgcattggcaggtgactcactgcatagatatgatcatcttcagagcctcattataggtttagcaattacattttaaaaattaacttggtacagctgagggtcatagatgacgcacaccacacttgctatttctcaatcctgatgtgaagttcataagcattgctctctggagtatgtcagagactaatgacaaactgattagctcatatggcttatgcaacaaaacatggcaaattttgttcagatatttttttcaaagttagtttatggtagaaatttgggctcatactagaaacagtctgtaactgttgtttagggaaccagctgagaagtatttaacctgtgtatctttcaattaatcttacttttcaaatgatagcagctaagaagttatgtggaagtgacttccattggagtggaatttgaatagtaatacattatttatatacctaaaggtagcatacaacaagattacacataaaataatacagtaatccgttctagggaaagtgtaaagacagaaaatcgagaccttggagaagaaaaacacaactgctgaactgtaagggccattaacatcgatataatcgagtcagtttttagtttttgtttcttaaaccctaaagcaaaagggagacattgcttaggtagatagttttagaagaaagcatataaagtgataagcataccaggcccaaagagtgaaatgttactgccttttgattgtaaagaaagggagaattacatggctgcagctgctattgtgagctgggcagaggttgctgtgtctttccatttcagctgcacagagagaaaagatttaggaaaatccaaagaaaaagataaccttgcagctgtctctgaaaagcctgcgttattactgtggtggcagtttcaggagctggaagtcttggtagaaggaaagctggagcagagacaaagagtgcaggtcctcattgatttcaggctggtgggatgccctgcttgtgtgcaccagcttaggagggggttggactcaacaaacataaacaaataataataaaagcaaactaatacaggttagattttatagtagttatggatgagaaaaaaggattaattgctttttaattattatgtttaagcattagcactccaacagagatcttaatttttgatgaaacaaaatgaggattagtgtgcattgtctatttcagtggtagcccgtctataactgaaaccatatgttatcattcagaaaactggaagacctgcccttgactaagaaatggccataatcaagtgctaacatcctctaattacaggatagggatgtagggatggtttttttttttttttttttttttttttttttgagacagggtcttgctctgttgcctgagctggagtgcagtggcgtgatcttagctcactgcaacctccacctcccaggttcaagcgattctcttgcctcagcttcttgagtagctagaattataggcctgtgccaccatgcccagctactttttgtattgctagtagagacaggattttgccatgttggccaggctgctcttgaacatattgaaagaactatttcaatacctttttttttttgaggtggtgtctcgctctgtcaccaagactggagtgcagtggcacgatcttagctcactgcaacccctgcctcctgggttcaagagattctcctgcctccctagtagatgggactacagatgcccgccaccatgcctggctaatttttgtatttttagtaggattggggttttgccatgttggccaggctggtctcaaactcctgacctcatgatctgcctgcctcggcctcccaaagtgctgggattacaggggtgagccaccgtgcccagccaggatgagaatgctttctgaattgaaatgatgtcactgcactgaaggatgggctctgctggaagtggagtatcttttggtgctgacatttccccccactttaggttttcctaaactcagttgaaagaggaacacacggccggacgcggtggctcatgcctgtaattccagcactttgggaggccgagacgggcagatcatgaggcaaggagttcaagtccagcctggccaacatataaaaccccgtctctactaaaaatacaaaaaattagccaggcgtgatggtgggtgcctgtaatcccagctattcaggaggctgaagcaggagaatcgcttgaacctgggaggcggaggttgcagtgagctgagatcgtgccactgcgcattttactgaatctaagatactaatgcaattgtcccaacattttttgtgtcactaagaaagaaataaacatcatcaataaattctgacactccatagaatatataatttatcccaatatccaaaatgctaaaacgtgtaaactatggctcttagaatcaattaaaaaccttttaaaaatatgtatgagaagaaaaacaagaaatgaatttattctgggatagtaattgttgaacttaatgttcatatttagtaatgaccaaattaatataagcaattacatttatcatgtcatgagtttggaaaaaaacataagttcacataatgtcttatgatccttacaactatcatgaaggatatgaagagtaaatattataacctcagtttgtcaaatagagaaactgaggtcaggagagattagtaactagtgtagggtgacactgcccaagctgaggtctgccattcacagttcaggaatctcccccgcccccttctagcatattcatatatgtcttttgacatgtcttttgggtaacaattgttattttttgataaactacaaagcacatattttagataagaaaataatatcatagtgttttaaggtctgtttgaaggaaaaaattaataaacaaatagtgggttacaaccctttgaaagaaaagttacaagaactactctatcagatgtaggaacgcttagttttaaaagtctctccccaagggcatctagcttgagtgccccactttggctgggctgcagttatcaaagtgtagctaaatagattacagtctgtgccaatgatggtctgtgagacgatgattgagagatgaagccatgtgcacgtgactctttgagagcggattatctcaggatgggaagttgcatggtgaggtgtggagtaatgagaatgcgtgagattttgggaaatctgagagccacaaaaggaatgaagacacttagaaagccgggacagctgaaatgaagcatatgtcctgaaaatatacaagggcaggcctgtgcgattctgtgagctattctgggttgcagagatttgggaggaaaactgatgaacccaaggctgtgagtacataaagcaaagttctatttcatcaggaaccaaagaactgggaggaaggaacctaggcatttggttgatttggtgaaaacaaaggcagtagagcaaggaaaagtagcaattgaatggtgggcatgagggataggcttctatttgcacagttacccctcagcagctgttgattccttcccaagcacaaggtatttcaatgacagcagccaggtaaataagggtgcttggcagtgacttagggatcaacctgtttgactttcctgtgcttgaaaaggaatggtaaataggaggagaaaaatgtacattatgaaaggagagttgggcatctgacattcatgaaaaaatctgacaattatggaataatctcaatgagctaggggcagtgcctatgttactttatgttaatctttgcagcagttgtatagaataggcattactatttccatcttactgcttcaaaattgagattcaaaaaggagagttaggcatctgacattcatgaaaaaatctgacaattatggaataatctcaatgagctaggggcagtgcctatgttactttattttaatctttgcaacagttgtatgaaataggcattactatttccatcttactgcttcaaaattgagattcaaaaaggtaaaatgcaatggctcatgcctgtaatcctagcactttgggaggccaaggcaggaggatcacttgattccaggagtttgagaccggcctaggcaacatagcaagaccccatctctacaaaataattttttaaatgtagctggtgtggtggtggtatgtgcctatagtcctagctatttgggaggctgagacaagaggattgcttgagcccaagagtttgaggctgcagtgagctatgatggtgccaccactctccagctggccgacagagtgagactctgtgtcaaaaaaaaaaaaaaaaaaaaaaaaagatgaaacgacttgcccaaggtcataataattggtagaaatgtgcatttgtctgacatcaaagcttttaataatattaccttgcctctgatgaatccgtgatgattaagtgaatgaaccaataaactaaaaaaaagaagaagagaatggggtgcacgctcccactcaacagtcgtggtttttaaaataaaatgtaaccattcaaataagcataaacgttctcgtgtcactaattttctagcactgctaaaagagggttcaaaataataaacacttaattctgaagtgaaagagtgttgttgtttcctggtctggggctgccttaccaagtattgtttgcagctgctgtttaaacaagcatgaacagtttggaggagggagtgggtgattagaaaacttgcaggacagccacacctttaagggtggcttgggagccttgaagcatcccaacagcgttttagcatttgtaagaaggctccaccctggactttaggttcctgcctacaactttttagagaaatggctgtaatgtgttggccttctaagcacttttagtgggctctcagattccctactcactcgatttctttgcatcttctttgcagctgggagaactgcttttctgctccacacagctttcaccttgacaaatgcgacttggcttaaatgtccctttagcctttttagcttgctcttctcatagcaaaaacagaaaaaaaaaaaaaaaagagcaagaataggaaaattacaattatgcaatgtgcagatccctaggcatgattgttgcttcccaatcaggagaagatttccctggcaaccgccctttcttactcccctggaagcccgaaattggtggaaaacttaatttgttttagattgcttaaaattaccttttaaggataagagtaaatacctacctctttaaatagaatttataccctttgtcacagctcttccaaataacatttttaaatgatcttgaaagaatagaacattgtaaacagtgatacatacggtaatttgcttaccatgaccctgtagaattattcttacccacaaacatttacagtatctgcagggtacccagcaccatagcaggggctgggtaaatacaccaaaagcattttataaaacacagtctctggtgttaaaggagtttataagttttgagtggatctggtgaatctggagggtggaggaaggaaacgagtaaagagcagctttaagtaagtcaagctgagtcgagtattaaatctcagtacctctgaatttcctactgggtttgaagcttgttcccataaatcccctttcctggtgatgaaactgttccttaaaaattgaacatatgtgtgtgaagtgcaaatgccactgataaatagccctgcaggggaatggcagagggcctaggtctgcagtccccaagggattggggagccatgggcctttggggactagtagaaaatgttactgaggtgctggatgacatcaaaaggggcactaactgtggataagacactctcgtgatatcacatcaagaaataataactaagatgctgggtgtggtagaatgcacctgtagtcccagctacttgggaggctgaggtgagaggatcacttgaatccaggagttcaagaccagcctgggcaacacagtgagacaagatattaagattctagtatgatgtagggacaggaagggaaatgaattttattaattattcacccactattttgacggtagtgaatacgtataggtttagctatcccagttccacttctggttcttgtagccaagcctcctgattttgctttgggaaaagctttctcctcaattcgaggtccatgtatttcaggagtagcccaagagttggggtaggacaatcagcaaatcacacttcctggcttcattgcttggctcagggcagaggtgaatgatctaagcttactcagtcagcaagcatctctggacctgtgcatgaaatgccaggacaaagatacctcctctctcactgaatatattaatagggatgcatgtgaccttaggacttgtcggtagccattttataacatctaatacacaaacataatttcacgtaatacaaaaaccttatgttatcttaatgccattgcaatgatgaaaaaattgagacttagtggtattaaataacttagaccaaatgttacagcttgtcagaattgaaagacaggtttgtcttactcaaatttctacactcttcttcacaccaggctgctgtctataagagtttcaaaactttgttatagtaattttctattaaacctaaaattcaagtgttaagttgctgagagatacaatcccatagcattttggaacttgtaacaagtactgagtgttagatgcttggcccagcactttgggaggccgaggcgggcagatcacctgaggtcaggagtttgagaccagcctggccaacatggtaaaaccctgtctatactaaaaatagaaaaattagccaggcttggtggctggcacctgtaatcccagctactcaggaggctgaggcaggagaattgcttgaacctgggaggtggaggttgcaatgagccaagatggtaccattacattccagcctgggtgacagagtgagactccctctcaaaaaaaaaaaaaaaaaaaaaaaaaaaaatagaggtctaggtctatggtaaatatattttttccactgactatataggagataagctaacttagagcccctttttagtttttaagataacttcattttctggtgtattggaggcatatctgttggcttggaattgttagttgagccatcatagctttccattattgttatagttactagtgtgctggtgtctatccaccatatcctatgatgtttgtggctataattcctagttgcaaacattgaattccctgaggcaaactagaattttgtgtctggtgttcagaagcagagatgtgggtagaagattagtgaccttcctcttgctgccaatagaagcccacatgtggaaacatcattcatcaacactaatccttggtgttgtctaaaatcacataaacctctcagcacatctgtctgttgctatacacacccaactacttgtcaaacttgtatattaattttttccttaggacacaaaatctgataatgttattattaacaaatagtatagctagagtctataaaatatcaagtcaatcatctcaagtattaatacttaattttaaaattaaaaattttaaaaaaggtttcggcaaatattttcctttagtctattatcaattttgaaatattaagtttcttaaatgaggcttacttgtgaatcattaacttacatatttgacatttataaacaaagaaaaatctcaatagatttaagaagagacacaactcagagcctcctgcttctcgtcatcatcatctgattcccactgcatcttggggctgtttggactttttattccaagctacatttataacacctgaaagcatacggcattcaaacgggccaaaataatctttccttcctgaatcccatccattctaatgcaatgaaaccgtcaaaccacatgcatctagttcttgagatcgggaaaataactgaataatattttggtgtcctcatgcacatgtgtgattcaaaattccactttcataatcatcatacagggaagttgcctcttgagggtgtgtactttaagctacgtttcaatctactttccacaggcagcaagatatctataatgaacagaggatgtcccacaaacatgtgtacagatgagtatgatacactcaatagttatccaaatcagtgcttccaggctagctcaaggtccattgaaaggaaatgttccaactggagtattcattacagggttctcttctttcactttaaactgattactttgtggttaagctggagttaaaagttccacttcttctgtgactttatcaaaatgctttagaagtattcattcacttgttcaacacatatttattgagtatatacagtcatcctatggtatctgtgggggactggttccaggataccaaaatccgtggatgcttaacttcctgatataaaatggtgtagtatttgcatataacctatgcattatcttcccatatactttaaatcatctctacattccttgtaataccaaatacaatgcctgcacatcacttcatttgtgtggattcaacatagtactcagggttcagcaaattcaagttttgttttgtgcaattttgtggattttttttccaaatatttttgacccatggttggttaaatccacagatgcagaactgatggatacatagagaggactgtatcatgaaacaggtgctattttaggtactggggataccgcaattcacaggcagagaaaaaaatctccgttcctcaaagaactaaaaatagaactaccatttgacccagcaatcatagtactgagtatatataggaaaataaagcactctaccaaaaatacacctgcactcacatgttgatcacagccctattaaactatactaaagtcatggaatcaacctaggtgctcatcaatcgtaggttggataaagaaaatgtggtacatatacactatggaatactatgcagccataaaaaaagaacaaaatcatgtcctttgcagcaacacaaatgcagctggaagccattatcctaaatgaattcatgcagaaacggaaaaccaaatactgcctgttctcacttgtaagtgggagctaaacgatgactacacacagacataaagatggcaacagtagacactgaggactccaaaagaggggatggtgaagggcaagggttgaaaaactatctactgagtactatgttcattatttggatgatgagttcaatagaagcccaaatctcagtgttatgcaatctatccacgtaacaagcctgcacatgtatgccctgaatctaaagttaaaaaataaagctctgctgtcatgaggaagggaaaggacagacactaataaaatgggcaaaatgtatgttaggcaatgatacgtactatggaaaaatgaaagcaggaaagggggaagactgtgtggaggagaggtgggtggtgggataggcatgttaatagtggcatcatcgcaggctacattaagagacctctaggtaccgactgactggagtcagggactctgccctggggtctggtggcagagtgctcaaggcacaaagaagcacagatgagaaagtcctgaagaaagggcaggactgccatgcacacagcgggaggccaggtgagtggagtggagtgagaggtggcagaaggtgaggacagtgatttggggagtgtgggggtccatttcaggaggctttacaggctgtggtaagggctgtggcatgtacttggggtgagatgggagtagaatggaggctttgatgagatacagacacattctagttcaagagaatcacgcaggttgctaagttgagaatggctcaagggcaacaagagtagaatcagagacccttggaggctcatgcaataacctagattgtagctaaaggggaggagccagggcagagcagcggtggagggagaagatagggccaagaggtttgctaacgatgatctggatgtgtggactgagaaacagtagttaagggcgactccaaggtttttgacctgatcagctggaaggactgaattcccattagctgagatgacaaggcctaaagaaggagtagactcaggatggaaattaggagttcagtttgggatgtaggaagtttgaaatgcccatgggtcatctaagcagagatgttgaatagggtagcttactatctaagactggggcttcagggtggctgcaaacatccctgtgggcatacacctgggacttagagctctgagaatgaaggaggtgacctaaggagtgagtgttggtagaagagagaaatggtccaagagccatgtccactcagcattgctccacccttagaagtttggagctaagaaaccacaaactaggcaggcttaaaacgatcaacaaagggtgtgttgtcggtcctggaagctgagtgaaaaaagtttttcaaagagaaaggagtaacgtactgtcacattgacttcttcccgtgatcttaatcccatgggacactaagtcagcaacgttaattttatctcttagtctcagttgccatagacaaaggattctgctgttcatgaatagctttatcttcccagcaagatgcaaacttcttgagagcaaggcttttgttttcttctttttctctctctctctacagcagtggcttttaaatagcttttggctacatctcacagcaagaaatacatcttactttggaaaccagtataagcacgtatacaagtgaaagacagagagaaatacttaaccttttggcatgccacacactgtctttattttcattctcttctgttgtattctatttaattaaaaataatggtgtttgtgacccattaaattgatttcactaccactaattagttgctaccattgcttagaaaagcactactgttagagtgtctgccacagtgctctgccacattcattattaatcagagagacactgttattcatcttcattccttctcaagtaccttctataaagcaagtacttaatagatgcttgccaaatgaatagttttgagaccctaaagtaatacttcttgaattgggctccttggtctttagttacctttacttttactgattgtacttctgtactgattgtagtcgtgtagaagaatatttcttaaaacctctgtgtcttcagaataaacacagacctgcatgtctttttaaagaggtccctgtgtagccaagagtcagacaaaacaccagccagggttggagatgacagcccagatgaagtgagtccatcatctgggttatcacatgtgcaaagttagggcaagaatcctgaagtttgaatgctttttcatgttcttgtacatcagcctctgggggccaggggcagtggtgttcaaaacatttttaaaaacaagacaggccaggcacagtggctcacgcctgtaatcccaacacgttgggaggctgaggcgggaggcttgcttgagcccaggtgtttgagatcagcctgggcaacagagcaagacctcatttcaacaaactatttaaatattagttgggtgtggaggcatgtgcctgtagtcctagctacttgggaggctgaggtgagaggatctcctgagcctaggagctgaaggctccagtgagttgtgatcaggccactgcactccagcctgggtgacagagcaagactctatctcaaaaaaaaaaaaaaaaaaaaaaaaggacaaaaagacaaaacaaaacctttaaaaaaaaaactttcaagaacaatcccatctttttattataatttacatagtattcaatgtcaatatgaaatattgattatttaaaaatgggagtagaaatctttcattaaatatctatgacccaaagtcgatggagctgggaaaatcattagtactaacaatgtcttagaattttgaaatgcccaactacagaaatgatatataatttaacccagacatttcatttaaagaatctttaaaataagagccaggtacatggtaaagtcctcaataaatgttagctaatgtttaaatccttctctatagagaatgcttataaaagtggcactgaagaaaataaaatatttttccaccatgtaattcttacttaggtagtttttcacttataaggaaggaggatggtgcaatgaatacagtacatcaggtcaacctgagttcaaatctgactctacttagaccagacatgtgattttggcctaattacctgaacatcttttaacttcaggttttcaaacataaagtgaggacagcaatacctacttcagagactgactataaagatagagatgatataaagtaacatatgacatgctaactcattcaaagtgtatttgtaggttgctttttcatatagtaatcatgtttaaataacggttaagttcccacatggtgcaaacccttaaagcttgtttcattcatgatagagctgacccttaatggattgtgcaatagatccaagactctctgagcttgggggtgggagggggtggagggtggggaaggttagtacacttgggggaatctctagaggcctgtgtataggggactgtggatcagtcagggttctcagaagagaacaggaaaaaaaaagatttattttagagatgactgtggtgagtagcaagtctgaaatccacagggtggtctggcaggctggaaactcaggctggagttgattctgcagtcttgagacagaatcttgtcaataaaacctcaatttttggtcataaggcctttcaactgattggttgaggcccatccacattatggagggtaatcttctttacataaagtctactgattatagattttaaccacgtgtatacaattactttactgcaacacctagattagggtttgattgggcactgggtactctaaactcagcaggtggctgcacagaactaaccatatagacaggaattcgggtgggcagcttctgaggcagtgggagggagacttgatgggcagacagggccgctgcagtgcttattgatattcagattctcttcagctgtgagctgcatatgctccgttcattttctgaggaactatggtttgggtcaaagacgtgagtgtaaagaccatctcctcactggttgttcaggagacccacaaaggccatgtaagcaaagtgagactcttactggctctgtaccagcacctagcaaggtgcctggcatgtcaatttcattgacaatgttctttaagggcaaaagagtcattcatggaatttttatttcttgttgacaaatgaacaggaaaatctacagtcacctgaaacatcccaccatggtaaataaacaggaaattggccaggcgtggtggctcacacctgtaatcccagcactttgggaggctgaggtgggcggatcacgatgtcaggagttcaagaccagcctggctaacatggtgaaaccccatctctattaaagatacaaaaaattagccgggtgtggtggcacatgcctgcaatcccagctactcgggaggctgggggcagaagaataccttgaacccgggaggcggaggttgcagggagccgagatcttgccattgcactccagcctgggaaccagggcaagactctgtctcaaaaataaataaataaacaggaaatttatagactcatcttttatttaagccctttgtattctgaaagacaaagaattccataatgcccggccttgataaaacaaatatagagctaaccttaaaaaaatcaagatttactgtagcaacttgcacatactactaatgtaacactgatcacattgttttaaaaccatttgtttatagatcagtctcacccaccaatctgtaagcaacttgagaggagggatgatgtcatttgtctggcagagaccaatattcattcctataattctagttctaagcagagtataaaagaaaacaacatattgtaaagtaaaagtgctcatgaaatctctaattacatcactcaggttgtacctattttattcaactgagaaataaagtatggacacctttcatcccagattttcctctaccaagggcagggaagaaacctcgcaatggttgtgggcaaacagggatcatggaggaacacatctccgtgcacgaagttgctggtgcatgtgtgtagagggggtatgaatgaccagtatccagaagagaggctcttttggcatccaaggagctgcagttggatgttgctgtggagatatttggggaagcaaggccacaacccccagcagggtcaactgaactctactaggcccagagagacccatcaccagatcatggcaggacgagtcaaacagaatctgaagactgtcatctcaccctgtgtattccaaagcacattttatggatcaccaatccttttttttttaatactttaagttctgtgatgcatgtgcagaacatgcaggtttgttggatcaccagtccttagaaatgttctgtgaaatgtggttccaagagggtttgggagatgctttatactgtattgttctcttaaagagtttccatccatatgagcatcttaaagattctaggatgtctgccaatatagaattctgaatacagtactcagtttctcaaattcaactccttttcttcacattaatatctattcaaatcatcctttgggaaatgtcagcttcttcacatacaaacaaagaaattgacatccagaatgtaaattacagcttatatggctaataagtggcagaactgggttagaattcagatctcctttggcccattgcactttcccagttcatcacactgcaactatttatctcaccactgaactcttcatgaatacctttcaacaaattctgtgaaactgttttgatctccctatatcaacatgtagaagacaaacatgaaggaatggctactgtgtataggagggactcagcctttggaaacttcatattttgtgtcaagcctgtgccaggatatgtttcattcaagttatcagtgcaaatgagaggtggtaatagagacatgtaagtgacatggatctatacaaataggtttgggtcacatcttgtattttacaccaagaacctagatcatgccaaccttttgatggtaaaaactgtaatgagagaagaatgcttcgtcaagataataaatgattacctttgcatatagaaataaccagaacccatgcatgcacactccattattccttctgtctcccgacattgactggaattcagtctttagtatcctctctctgtcacacacacatgaacgcacaagcacacttcatattcagtgatgatgtttttcctattacaaaaactgtgaactacccatggacagtaataatgcagatatatttcatttgagaaaggctttcttttgtcattttctttctttacctttttggtgatgagtcaagctgacctgctgggtgagatggttcagatattcatgcttcctcctagtaacgatgctggctttctgcaattcaaatgacccactacagctgcacgagtaggcacttagccacctactccagttagtaattattcgtttagactaaaaaattctgaatcaatagaaaaacattgaattaagcctcatttttgatatctcatttgacaaaggaatcatgttatttttccttgcagtggatttagataaacatccagaaaaaaaaaatgttttgtgttggaacggccacagagaaccttctttttttttttttcccaggagggaacataattctaagtcaggaaaaataatttatgtggcttcctagtttctgcccaaaccagccatatgctctcaatattactggaagaagtctgaaacagaaaatacaaagtaggggcaagaaggcccttgtgggggatgcaggggtggaaaacgggaggcagcttaggtgccccccccatcactgaggcagaggagtgagagcacctttctcctttgtacacccacttgtctgtcaactttcctccttccatttgaggctgctcctggatgtaaattttgacctgctttcagttgtaataaatacatgaggcatagaagtaagagaagctcaaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacaggcacatgccaccacgcccagttaatttttgtatttttggtagagatggggttttgccatgttgcccaggcttgtctcaaactcctgaccctcaagtgatctgcccgcctcagcctcccaaagtgctgggattacaggtgtgagccaccgcatctggactgttttgttttgatttactaaacagcttttatttttctcttctgttacacagaaacaaacaaaaagataattattttgtttgggaggcatttgggtatcatgaaatatttaaatcagagatttctagcacgtgtgatcaatgaaaatagagggaaactaggacttctgaactgatttccttttggagcattctcatagatgaatctacaaggatacaatgatttgtctgaatgataaatttacctgaataatttatctgaatgataaaattttgatacctttattaagatacttgaaggtgttggtttacaaaagattaagtaccacagtgtaaaaattctattgttgcattaatttgattagcaatgaaaaactcagaatccatttctaaagaagttgataatacaaataaaacatttacctaaagactgactatacacaaataatttctgcaatttatccaactcataaattggtatagagatttatgggccgggcgtggtggttcacacctgtgatcccagcactttgggaggccgaggcgggtggatcatgaggtcaggagatccagactatcctggctaacacggtgaaactccgtctctactaaaaatacaaaaaattagccgggtgtggtggcgggcacctgtagtcccagctactcaggaggctgaggcaggagactggcgtgaacccaggaggcggagcttgcagtgagccgagatcgcgccactgcactccagcctgggagatagagcaagactctgtctcaaaaaaaaaaaaaaaaaaaaaaaaagatttatgtaatagatgattaatcatagcactggttgtaaaagcaaaatgcatggtagtgaatactgttccccaatatgtattgctaatatactagttctttaacatgtgatgttaatatagtacaaagtagcttcattaaagaaagagttttgatttgattcaatcctgtgttcccggtgtctggaagtgagcttggcacacagtagatgagcattaaacatttgccaaatgaatggacactccatataatcaaatatatgtacataggtgaatgtgtacgtacacatatacatatttgtatgtttgactatatgtagaaaatagcagaaggcgaatgttaaaatggtaacagtgatggctgcctttggttaaataagactggaacacggtgggggagggagcttttacttttaaccctgtatcaatctgtactatttgaatttttttcacaattagcatatgtaacttttattaaaaaatgaattctgtgaaagaaccccaaatgtacgaccactggagatctgcattttagaatttgtgttgtctttacattatctcaccttaaagatacaactccattatgtacacgataacctaaggaacaggctttgactggaaattgatgaaacttggaccacagaatcagaaattagaatcttcaaagaatcgtcattacagattatattttgcttttccatttcttcagcttcaaccagaattttatattcaaagttaagaaaatttacatgtaactgtatgcaaaaacccatatggcctgtgtcagtctgtaccacttattttcaatgagataaaatagcttatttaaactttgaattttcccattgggtttagatgatttagctgtttatccagcagccctatacttaaaaatagatgagatgacatttgtgggttctttaaaaaaataccctttggagaaagaagcagaacactaatgccatatttaccatttacattatataagaatggcaagtttttatagaatgagtgcttcatagaaaatatcctcctttctggccaggcgtggtggctcacgcctgtaatcccagcactttgggaggctgagggggcagatcatgaagtcaggagatcaagaccatcctgggtaacacggtgaaaccctgtctctactaaaaacacaaaaaattagctgggcgtggtggcgcgcgactgtagttccagctacttgggaggctgaggcaggagaatcgcttgaatctgggaagtggaagttgcggtgagccaagatcgcgtcattgcactccagtgtggcaacagagcaaggctccgtctcaaaaaaaaaaaaaaaaagaaaatatcctcctttctaacataaaagctatagctcttctgtaaccagtcacaatcattgcatatatgagggcatcccacataagtttcattatttgatgattataattaatttaatggaaacataaacatggttggaaagtttccaataatagcataggaagatttttctctcccttctcccttccaattatgtagtgcctccccgccatcgccatcattcttttatcaattatttattgtgtgtctgctatgtgggaggcacagttgttataaaacaaatataaagttgatgttgactatatttaacttgaccttatatacctatttaataattatagcaacctgccaaaaatgagaagtgattaatattagccctaaacctgctgtcatacgattccacagagttcaagataagaattaacataagttaagctgaaaatatactgtcacctgaaattgcaaactgggtaggtatacaggagaacgatagtcaattaaagtatgaaatattcaaatcagtgttccaatcttggtagcattgctgatggcaaaggatgatgacaccaggaggaaatgaaagcaaacacatcactttcctactcagaatagtacacctatcttaggatcttactgattttatttattaaaaaaatacactttaggagaaaagtgcatttatcgggtaatatgaaagaggaaatgaggtctgtgtgagggcatgggtatatgccatcactatgcaacattttaatcttcagtttttataggagtttcctctgagcactcatcaaaggtaatgggattagattttttttcttcctttgtcaaatgttttcctcaccctgaatactgtcacacacgtcgcaggtggatgagatttgtccactgaggaggaattgcacttttcgaccctcctaggatgtgacttgaatacctggcttgttccatgttgggcttgccacctgctcctgctctgaggtagccgctgacctaaaggcatcgcaagggtggtgaggtgaagagggagcaagtgttctcagccacacatttttccatctcccctcagaatccacctctcagaggtagcctaagtggccctcctaccggatgcgttgttttatcacgactgcagctttcttttcttagattctgccaatgcttttaatgggctggtcccctgcgaagagcagggattttgtgttttcttttgaagagcgtggtagatttctgagcaccctgtggcagtctgtaaaagtgataaatacaaatgatgaacaatgaagcaggctcttgagttctggggctggctacaggagaactcagaacgagggaaaaaaataaatcaatttctaacacaaaggcaagatttagcctctcattagatccaactgctacatgtaaagaagtttgttaagaaaatggcacagggattttgtgaggtggagccaagcctgcgaaataggctttcaagatgtgttttctatcttccttccaattttgggtgctatgatgtaacaggattttgaaatccaagcatatgttattttctttcttcttttccttttatgtttaaacctccattatgatgaattagctttccttcctcaataatttagagtttattttctataaaaaggaagcatttagaaatgtgatattaggcatatggccccctttcagatccttccagttctatttgtatatggttttagactcagctgtaaatatattaatttatgcagcaatggatattataaatcctacactttatatagatgtaggctctttcttttcataaacaaaacttgaaacaatactaaatttttaaaaagatagacataattgataatttcactttgagaaagcaaagtaacccagattgtaaatgttatggacaaaggctgggcgcagtggctcatgcctgtaattctagcacttcgggaggccgaggttggtagattgcctgagctcgggagtttgagaccagcctgggcaacatggtgaaaccccgtctctactaaaaatacaaaaaaaattagctgggcgtggtggtgtgtgcctgtaaagccagctatttggggggctaaggcacgagaattgcttgaacctgggagacggaggttgcagtgagccaagatcaagccactgcactccagcctgggcgacagagtgagattctgtcaaaaaaaaaaaaaaaaaaaaaaaaaaaaaaaagtcagggacaaggataaatgcaaattgtacacatttctctctcttgattttatgatagtttggaaaagaaccattttttaaaaaccagtatattactaatggatggcatctaatgtcttagtaattaaaaaaaatatagattgggatggagccacagaattcaacaatggggagaagagagaaatagaaggcagagacaattttagaataatagtcaactgtctgtggaaaaaggggagcttcagttagtgaatgaaagaattgagttttcctgatgttttcatctaagattaccctcataccacatgcacagggcttgatcataaagtatttgaagttagtaaaaatgtaactagtccagttgagctaaggaaatatcaaaatgtcaattgttctttcccaagtttagtcaagctaatcagattctttcagttgttaagaaatattctgttgtatggtttatgtgtaaatatgactagaaattctcagcagtggtaaagcatcgtaactgggcatggttgctacacatatttgtatctctgatagtgcctggcattgtcccttgcatacacaaaaagttcaaaactacatgcttaaaagtgaaggatttcactctcccctgaaagcactctatttgatagagagcagcactcttttgtgcttacagcaatgagtaaactcttagagccaggttgtgaactgcttgttgtggatatatgctgtagacatttaatcacttgataactcattagtgatatatttaattcatctaagatgatttatgtttcaaatgtgaacatgatgctttaccattacttttactatttaataaaaagataattgttgcatccatttataaattttgcattaaacatgacacatttatcttttcaaagaaaataattgttaatcttagaaaattttcctcaaatgtgcaatacaccaggcaaaaaccaaactctggttttactgtacttgaaaataaattagcatgcatttcacatggtattttgttattctcctttcatagcctgctttggttaaaaaaaaatcatgtcataaaagagatggcaaattagatctgggagtgaagaaaacttgttcctaaattttatcttagatattgaactactaaatagatgataatgaaattaatgtctatttcatgcatgaagcagctctattacgtgcttttataatttcttgcttttgagaggttaaggtggaagggcttattttctttagacactgatcctgggattcatgaacttcattattctctttatcttatgataactatgcccacagggtacaattaatgaattaattcatcaatccactcattcacatttatcgaatgcttcctgtgtgccaagcactgtgcgagtagaaaccacaagaatcaataaaatcaatagacttatatttgtctctagggggtctactgtctattgggggacaggtagaattattggaggggagggagcaacaagccctcaaacttggtgtcagcaaagtgtgaaaatcactagaaaatccacacgtaggcattggtagcatgggagctagtttaaggaggttatacttgtcttgggacttgagtgatgggaaagactttggcaactgggcaaagagaagagaggagggcagtacagaagtgggaacagaaacatgagcacataaacaggcactatatatactcatgggaagcagcaagcttcacttcggacctagggcctctcagggtactgctagaaacagattctgttgaaggtattcagcttgtgctaatagtctgtacttgttttaaagacccaggaggtctttttcagaatgtattttcttgaacagcctctttctatcaccaacatggcactgagaacaatagaaaacagctccttttgtttctgggacacacctcctcttttctaagattcatgcctggttgcccagggaaattcctcaaaccagcctttattctgagctgatcactctcttctgaacaggacattccgccatctgctcagacaccctggctgtcagccccaccctgaatcaccaggcatcacctcccttctcaaggagacctcacttctctttatgtctaaagccccacaaatggctttactccttcaaaaccctctctttctagacttcctctagcgccagcgttgcaattcctctgaccacgtatttaggcacacatataatatttagagggcctctctactccacatttaaccctgtaatatcatcttttttatattaacatcttattcctctttatcagctcatttggagccatgtttcatttcccaaaatatcaccactatattcttttggctgttgcatcaaattaccataaacccagtggcttaaaaaatctcatatttaatctcttacagttgtggaggccagaagtccaaaatagtttcactgagctgaaaccaagatagcagagctgggcgtcctctggaggctcgaggggagaatccatttccctgccttttccccttgtcccatggtccctttctccatcttcacaaccaagagcaaagcatcttcaaatctctctccgcttccacggccacatagtctccctctgcttccttcttaaaagaacacttgtgattacatttagagcccacccagataatccaagacaatctcccaccttaagatccttaatgtaatcacatctgcaaagtcatcttttccacataaggtaacatcctcagtttcctgagattagagtgtggccccatctggagcctctattccactaactacgaccacccacactaacaccattgttaatcgagtacttactctgtgccaggcattattttatgataggcaccatcattatctccattttacagatgaagcagttgaggcacagaaagctttagtaatttagtaaagtcatatagacagagaagtggtagaaagagcattcaaatctaggtctgttcaactggaaagctgtcactcattcacggaacaccctgttgcctctcacattttccagctgactgtgtgcgtctgtgttctggtttgaattaaaggaacctaaaaactctcatggtcaacacaaaatggaaaatttcccagaaactgcacatgtctcttctctagctgtacttgtagatatttcttccacaaagagcatagctaattaactggttaagtggtaacaagtagcagtttgcttccccagtgaaataccagtggaagcccccctaagtagtctgacatcaggctacggttgaagaacatgaagggccaactgagttcaggcaaagtgctatggaaacagtaatcacagagcaggtccaggaaaataatgcctgtttaaaaggacaatggaaatgaaacagaaatgtaaggcccagctactttctctgtagagaaagtgagaaaggctgaaaactcctgtagacataaggcttgaagaagaaagcttgagaataaagaatacagcacaaagggaagtactttcagtttaatttaagggaaaaatacactcagggctgactattggagatcagaaggcaaatgaacactggcaggcagtgagaaattaaggatttaaaaaatgatccttatacatttttaagaataaactttttcttttattctaaggaggcagtaaatcacgtggaaaatagaaagaactggtccctggagtcaaacagactgagggtcccattccttaatatcagcatcatacatgacaacttgagcctcagttctttcatttacaaaatgggaacaacaacacgaagattaaggaaattatatgaaccaccttagcacagtactttgcaggaatgagtagcataaaaaatcattgcatctggtttctgcaacctcagcaagacaaaaggtaatacagcttgttaaagagtccagctagctactagtgcattcagagagaattcactctgtgccaggcatggtgctggatcacgggccacaactatgaataagagaccagctatgttctttcatgaaacgatctagtggaagagtcaaacaagaaaacaggcaatcctacctaagatagaagaagcatgataaggaaatgatgggtgctatgagagcatattgggagaggatacctcacttaaacttggccagtcagagaaggcttccaggaggaaacattatcttagatgagactggaaagttgggaagaggttaagtagggaagagaggagtttggcaggggtggggggtgaggggtggagggggttgtaggcaggcagaagagacaaaggaggaagcagctcatgcaaaggtcctgggcaagagaacatggcactgctaagaaagagaaaagcagaccagtatggctgaaatgcagagtggacagagggagtgttaggaaatgagattgtgaaggaaaaaggtccccagctacatcatactctctaagtcatgtttaaaagtttggactttatcccaagggtaaagaggaaccagtgaaggatttttaagcagaagatttaatgattttatctgtattttagaaagatcatttgggctataatgtgcaggatgaactggatttaggagaaactagaggcaggaagaccactaggagatatttacaatagtctagctgagaaatgatggaggtttaactgggatcgtggcaaaaggaatggcgagaagtggacagaaataagatttggtgtttttttttttttccactcattcattcattcaactaacttttatgagtctgccttagaggagagacacgagggtgagatagagagaggtatcaagattggccccatgtttcagcgttaaaaaaaagcatagatagtggtgccatttacaggggtaggaaacatggggtagcaggctcttgggaagatactgagtgcagtttttgacatgataggtttttgtgtcatgcctttatttttgtaacctcgatatctttgtgtaccccaacctgtgagaatagatgaggtcatattaacagtaataaccaagtccagtgatactttagttctctctcatctttgttcctcgcccagttaattctgattgtccacaaggatgagcttcacgtgtatttgggaacaaatctgtttgctgccttctgtcaggcctttttgcaatggtgccaagaacttcttatgactgtgggccatctgtactgatgctgctgcctcagtcaccactgtcctcagctggtacctgctctgtggcctttgatgtgtgtgtgtatatagggaaggtgggggtgcttctttctctagatattctctattaattaactaacacagagctaatatgtgagtttgtaaataacacatgccttgcatttggcattgctaaaaataccttcaagggctaacaactttgcatcttatctcccagcatgcatgggttgaccactacagacaaaagatcatgaagctgatgctggccaaagagccttgcacattttcaccctcaagttggttttatgtagcaattgcggataaaaagctctgctggtataaaaatcttcttattgtacaaatggcaggaaatagaagacaacattgcggtggttacaaaaatttgtttcctagtttgtttctgccagctttaaattgaacatagatcaatctataggttctgaattagtaatattggggagacatgaaatgagaaaaatagcagaattaaataagcataacagtgcacggggcagcccagcatgctctggagcgatgaggggtgagagagaaaggaagaaaagaagaaaacaaaatgaacacctttcaaatccaaaacaatgcaccacgtttgagcctccaatatagttttacaaagacagaatagccatgaaatcaaacatttaagtataaataggtaacatatgtctgtcttattgttgttaaaaattaactgtgatagactgaaattccattccacattcctacttcttgatgacttagtaaattacaggcatttcaagagaaatgcctaaaaattttaggtgaaccatcgacgatattttgggtggaagtaagttatatgtggtagctaaatacttgtgctcaagctctcagcatcctgtttatacttctaggaaagacatatgaaatgtgaacaatttcaaggaatgaaataaatgttcttctttatctataaaagtctgattgtggtgtttaaaggcttccatgaaacaaaaacacctgtgcccacagctcgtctcccgtgcataaaaacagaatacaaagatgagacagtaggaataggaggaacattttctatttctccaatatttcccacatgctttggctgtttttgaatagaccttctgaaatatcttttgaggtcacctactttgtgaacctaaagtctctgatttttcaggtgacatggcagcaagcccgaatgtctgaaaacataaatcttagttataatttccatttttgtcattttgctagaaaagaaaaatatgataatttcttccccagcttgctaagcctttgctagtttcaggaatttctgctaccatctgatgaaaatcaaaatccccgtattaaacaccaaaaagctatatcacaaaaaagtgaagccatcctagtaagtgcctcatcacttcttgtttttgagatagagtaaccaaggtagcaatagaagtctcagagagagctgatggtttctaattccataaacttagtggacaagtacattttccacatgaaccaaaatcattgccgccatggtgaatcaaaaaagtaataacaaaaattcacattaccagcacgctgttattttaaaaatccaattttacaaaataaaactcacctaaactgaagctgtggaataattttagcaattgaaaattactaccttctctagaataacatgtacttagaaatgaaatgattcagaaatcaacatgatgtacgtattctgcttttctttgcagcttagagcaaattcaacatcaatttacactatatcatagtaaatatattcaacaatcagtgcttaagtaatttagcctgtctttgctgcatctaaatattctgctgtttaactaaattcactccatactatagatgataaaaatattaatatacacatttcattcttattaaaaagctggatttctcccttagccctgcaagtaccataagcaaccaaatcagaggaaaagggtatgttggggctactctttataaaattgttcatccccagttcacagacatcatgaaacatgaaattaactccagtatgttaaaagaaagatgatagattagcacagaaatcaagcacaaagaaacgatttattttcctttccatagcccagaattgctattagcttaccttattagctggaatgccaaacagaatgtctttatggaaaattaagttcattattcatctcagctttgatttggtatagtgcagctgagagcatttagcttctctctatgatttgccgattctaagt

SEQ ID NO: 244 - DNA, 349329 bp, Homo sapiens; identical to SEQ ID NO: 243

SEQ ID NO: 245 - DNA, 378224 bp, Homo sapiens
agcagtgcattaattattttattaatttcttctttttacattatgggaaacattcatctatttacaatatttttttgttcacacacaatctaggtaaataagcctatgaaattccaattcataaagccataaaaatgttcccacccctccatctgaaggctttcaaatgaatcttttttttccaaaccaaaataatttttaaaaattacatttgggaattcagatatgctagtgatttacattccagttatttaaaatatgcatctagacatgttttaaaaaagaaatggtaaattcacaaggataaggcttaaatgaaagtggtaatgcacagtaaaacattaaggaaacatctataaataacagaaatatattacaataaattagttctatttaccatttcaaatattaaaaatctttaatccatttcttcatctctctttacaaaaaggttatgtgaattgtatggaaacatctgcaaaaaatataataaatacttaatttctttgaacgttttttgatgtgggagacaaacttcttttgtaatccccccctccccaagaaaatgcccaacacctttataccaaagttaaacaaaataagtaatttttcagggtacatacattttccattacgaactaaaaaacatttctacaaattacatcaaaaagaacaatgtaacaaaggttatgctcatgaatgtcagtttcaggggtcaagcagcattgtgtggggtcatgttctaacaccaataattagctttttataaagtgtttgtacaatttaaattgtattttcaaggaaggcaaagatcatgatgccctgtaggccttgagctaaaagatttaaaattcttaccaaaaatagcttatgaatatacaaatgccgttcacttagacaagataaataggccttctcttgtctctctttaaaatatcatgggctaaattagtttccaaagaaaatattgtaggatgatcttgagtcgtattagaaatctatttcttaatccaaatctcaactctacctcagggcacggagctgtaattgtgagcatgggtcttgggatgaacgctgcttctttcatattaatctgtgagttccaagtcattctcagtattgaatgtgaccataggctacccaagtggcagttggccctactcgatgcaagctttgtgtgacttttaattgctgctacaaggtaaagaaaaggtgtattctttttaaaactagcaaatacttgaagctcaaaatctctgtatgctccaatttcacaaagcactttgagtgctttgttcaccctagttaaaagttggttcgttggtttcaaaataagtgagtagcccttttcttgtaaaccacagcagtaaacatttgtgccctgtttataaaggtagctcaaagcatcgatggctctgagaggtagcgaattctctagtggttttagaatatgtccgtgaaaatatctgttgctagaacccatcacctctcttaatttcataagtaaaattaaattagcacctggctatgagagtgtattattttaaaaagcttctctggtgcaagcatgtttgatgtatgtttttaaaagtctttcgtttttaatttctaatgctttaggatgttagctggacataaaatgccattgatacttaagattgccacatcctaagtgtttaaactgtgacgagtaagggcatttaaagacaacttcagctagacaccgatgcatactgcccatcaatcaagactaaaaatctaaatcaacactctctgccaaaagccttgacttctttcagtgtttatgaatcatgactccccccacctcttcatggctgttgaccctggcaggtcgagtttcttctctcactacctggaacctcaagatgacagcggcagctcttttgaatgaggcagcatgtctattggggcaaaaatttattttagccatttgacacaggacagaatcctatgctaggtattactggactctgcagtagtgagaggagatgaaaggagaaaatatatctgaaatacgaactacttgggttaaaatagacggatgtgtagcattcaaagggatggtaggaaaacccaaactcttctccaaaaacagccttgctgccatttacagcgctttataagcagatatgtacttatatatgtggaatcaggtaggcccacctggatggacacttaacaaattaatagaaccaacactttccctttaaaaacagccgccacgacaacaatataaatatacacagtacaataagagttgagaaaacatttcaggtctagattttcttaataatagaacaaaaaaatcccttatgtagtatactaaaccatcagtgcctcctttgccttgcttcatgttattgcctttcagaatagattaatttccctgaaagatcgaatttacaatcttctgctgattgagacatttgaagctgtgattgatgaagtaacagtgaggcagtttgtgcagctgtgagtgtgcaggtgcccccagcacctgcagatttcgcttctcccatccttgctacacatccaggtcccccacccccaggccaggcttggtcccctctctctgtgtccctcatggattccagtgagatggtgtgatttctgaggttgggaataaagtgctccatctgcttttttaaaagaataaccatttaggggaaataaagggaatcggaggcctagtttctttcacgtggaagacggtaagtcccaaaggatcaccctgtgatactggatttctgaaataccctatggttttatattgctgaacagactagctcgagagaactgaggacggcgggtgacctaaaggcatcacttctacacaggtgggtttggctttgcccagaaaataaagggttggatctcagtatgaggcagggcgacggcatcaggacagggggcgaagctcggtgaagaaggagatgggcaaacgggtacgggaagtggggggctgaggggggcccggggggcggctcctgcgaggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcactggaggaggggcccttctctcctgatcaaagcagaaggttcaggacattacacagcttctcaggacaagcttgggaaaaactgggataggtcagtagttagaacacacagttttttacctaggggtggttagttctgatctgcacactgcatatctacttttttcttcattattctggcttgggcattcaaaagatgcagaaaaaaaaaaatcccggtaagcttaaggcccagggtaaggctgggttgcagaactaggtctctccaagggaaggaagtgggtattttaaaggccccctgcggaaagcctgcggctcccagcacattgagtgcggttctctctggagactccagactcctcctggtgccagagatgggccaggaagcagcggctgcagcagcatcttagaacccctgcatcccctctaaggatgcaagtcaccgggtgcaagcttggttcagagcttaaaaacatctccgctctgtccccggcccgcccaccgtccccttcccaccaaacctaaataaacagaggaggaagaagagatatcagattgtgttctttagctttgttggtgctacaccaggttagacccttttgcacaccacacacgaacacacaagcaatatacaatatacagggtcacgggagagggaggccattgatatttcctacactcgagagttaattaagtcagttccaaggtgactctgactaggggcctcgggataactgtggtggcccaggaagcaattccaatcacaggggcagaaactgtgccatgaaaagttgacacaggatgaaagaggtcattcctcttatcagcagcaaactatgaaatgggcggatattttcaatgccactgcaaaaacaaaagacagtcatctctttggcattaaaaaaaatgcagcaggaaagaatggcgtctagaccacaaaggatttttaggcaaagaaggttgaagttgtagactgtgaaagggtgcacataaaactgatgttttcattttaaataaaataccctccattctcataaaatgaagcgtgaacattatcttaaaatatagtttcggtgattctccaaagagtactctttgtatcttaacaccaatgctcagcacagcaattcctccctgcttgccagagcaagtgcctagttcaacttctcaccctggagctaccccaccggctgtctaaggtggagtctgtgtggcttaaaagagaaaaaaggagagcctggagtgcaaactatattctcccaactctgattgtgcttgttcatttttctcctcaggttcatggggtgatgaaaagctctgatcacaggcaaagtccattaaaaaccgtaaaaatcaagctaactaatgatttactatgtaaatatcaataggttacatatatcaattcttagcatctcttcttttagacattttaaatcttcattgtggaataactcagtggatatttttagaaatatgaatattggatattttttagtcattttcctttccttatacatttggattttttaaacaatgattactattattattattattgagacaagctctcgctctgtcacccaggctggagtgcagtggcgcaaccacggctcactgcagactcaaactctccgagttcaagcaatcctcccacctcagcctcccaagtagctggcactacaagtgtgtaccaccacgcccagctaatttttgtactttttgtagagacggcgtttcaccatattgttgcccaggctggttttgaactcctggactcaagtgatccacccgcctcagcctcccaaagtgctgggattacagacatgagccaccatgcccagccaacaatgattatttaaaaaaaaaaaaaaaaaattagatgcatcagctctggaaactaaattaccagtatgtgtgcatttgtagtgttttcttaaaataagactgatttaaagcttatctagcagatagttttaaacacagattaaagaaaactagattgggtacaaatgtttggcttcccaagtgagaggccacatgtacatcaacagtactttccaacttaacactacgacccccattttgatggtgacagaattggaaacgggggacagtgatgagagcatcaccctcctgtcacttacagatggtcccttgggactggatttttcctgggagaccattgaccccaagaaccctgaaaacatgatatgcggtagcagaatggattagattgctgttagctttctggtaggtgaggggacctgaaaagaacagggccaccagcatttcaagggaacagccattccaattttcagaggttgattctcttggaattatttgacctgaggccataggaaagcaaagggttaaaaaagtcacgtttgacatgccagcctggggagctggacattggatacccgtgtgagcctcgtggaacaccataatcaaatgtgaaaattagagttgattaattaaagtaaaagaatttaagtctttatttctaaactgatgcatgaggaccccagtgagcaatattccccaaggcaaatcaaccaaaagcaaaactgttttgaaaaaaaaaaaaaaaaaaaacccaacatttatgtaattactgtgaaactttatggtatatatttttagacttgaacaacagtaatttctttattactatatttatgaaatgattatcaaagtcagttatttttcagggcatcctatttttcttgaaaacacatcctaggggtgtaaggaagttgaactcttgttctatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactcccatgaccatgctgatatgttatgaatatctctttttgttataactaggcctttttgtcttccattcctttgcataaagaatattacccattcaactagggaagtggttgtataaattatagtacaggaatataatggaatactttgccattgttaaaaagagtgtggttaacccacaagcatttatataaaacaatgtttaagacctaatttcaagtgaaaagagcaaattgtagaacagtatgtataaagaaagtttagacatgggtatatataatatatgcttagaacatttctgaaaagattcataagaaacagaattcttacctctatggagggctaaaaagggaatgaagaggggagggggactttaacacattattaaaatatttcttggtggtgttaaaatttttatgagtattatattttgtaataataaaaaaggaaatcttcccattatttctaaataaaaaagagacatgtgggtatggtgtatattggagaatggcgtatcactacggcaagcaagacaaaataatagcagcagcaacaaggagatctgacctgtggtattaggctgtttttgggtcactagaaagaaatacttgaagctgggtaatttataaagaaaagggttttaatcagctcatgattctgcagggtttataggaagcacggtgctggtagctgcttctggtgagtcttcaggaagcttacaatcatggctgaagatgacagggtgtcagcatgacacacggtgagagcaagggagcaagagggtggggaggtgccacactcttgaacaaccagatcttgcgtgaactcaaagtgagaacccagtcgtgttgatgaggacggcaccaagccattcattagggatccgcccccaagacccaaacaccttccaccaggccccacctccaacactggggattacatttcaacatgggatttggaggggacaaacacccaaactataccacctgtccttggttggcttttgatttttggtgtccttatttatctgtgtaacttcgtatatcagccctttccggtaccatcctaatctctgcttctaccattctttccctgcagcagtacaactttctcttgtctcttacttgatttcaaactgtctccaatttgtctctctctatctcatctagaggcaggctagtatagtggttgataacatgggctctgaattcaaatcccgactgtgacacttctagctctgtgaccttggaaagtcaattaaatttatgtgccccagtttcctccttgtataacctagttaataatgattcttgtcttataggtactattagttattatgtgaattgtgtctggcacagaggaagtgcttctaagtgttagtcattactattcttcaaggtgattttttggggggttaaaattagatatatttcaacaagaaaaacaaataaagaagccaaaagaaaaaagtaagagaaaagcacaagaaatgcagcaaaaaccacccagaaagcctcttcacgagaagaatgactgctgagatgttagaagatatccttccatacatatatactcatgtaaataatatagaatatactttcatctaaataagaaaaaaaatctctcttgtaattggctttttgactccacgccacgcaggccatctgtgtttttgtttgtttgtttgtttgtttgtttgtttttttgagatggagtcttgctctgtcacccaggctggagtgcagtggcgtgatcttggctcactgtaacctctgcctcccaggttcaagtgattattctgcctcagcctcccaagtagctgggactacaggtgtgtgccaccatgcctggctaatttttgtatttttagtagagatggggtttcaccatattggccaggctggtcttgaactcctgactttgtgatccgcccgcctcggcctcccaaagtgttgggattacaggcatgagccaccgaccccgccacgcaggccatctttctaaaacaacacttacatcacttcattatctggctcggctatcagtggtttcctattgctcactttattaaaacaaaatgaattctctggatatgtaaggatcttacttagaaaagtcctcactttctatccaaagatggcttcccatttttaaatactcttctaatacatcagtcagcttaatttctttatactcagacaaaattcctcctccgtagtctgttgcctctcagtgattattcagattccaaatcgaatcctttctctttcatgaagtcatcccttcctattttcaattcctattagtttttcttttttttggacaaatatagcacttttagttagcggtaacatacataatgtaatttcaaaacttacaaataatgatacaaaattgttttcattgctcttggcggcactgaatcgtatatgtgcagtggagacagagccttatagctctcttgtctccctcagggcatttagcagcttgaaaactttgattcctctggaaagaagtcttggttgagagtgagatgacttgggtcctaaaccttgctgaagagcttaagcgaggcacctctttacttggggcctccatatcctcatttgcaatataaaagggttggaatcatctttgaggatccttttagttttgcttctaagattttttattcattctctctctgaagaaaggctacctaaaaataatgccattggtaaagtggtaaatgtttagaaactgactttttgggaggaagaagctctgcctcgtagagcgtgtcgatttccatggtgtaaatatttccatcacggccaatatcaggctcccaggatgacaaaactgaatatggagttgggaagagatgtccaccattggctctcattggacgactggaccccccctagcattgtggagtggctcctttcaatgaagaaatgcagcctcaggctagatgagcacagccagctagcttcgtctccagcttctctcactctaaaactccaacacaatctttcttcactgagtggagaaggcgacgacaatggaaagtgctcccagcttggcttttcaaacccaggctctgaaggcacaaaccccaggaggaggccagtcttctcaggcacttgtacccacagcagtgtccatctcttttggaatctggcacaggaatgatgctaccgaggtggtggcaattttatatgcagttggtaatttggatctgttccgagagctctcagctctgccttttctgggaaagaggtgtggtccaaagaactaaaagaaggttctgagctgtaagtcaagaacaatgtacagatggtggaaacagtctccagactgttcagggaaaagtcctcagagtttcatgagtcagtgggaggaaagaagttggagagaaagtagagggctggagccgaagacccaggctctgcctcgtgaggctcacaaccatgagaaagccttggtgtatcagtaaagtgttggttaaaaatcaactcgaaattccttctgacaccgttgggaggatcttatcatatgtactaaaaacatttgatgactgttatttatacttatttatgttaaacaataggaagaaaattaaaatattactagctatcaggatagatgatattttctcttcattggtttatgtaggttcatatatatatatatatatatatatatatatatatatatatatatataattttttttgagacagtctggctctgtcggccaggctagggtacagtggcaagatcttggttcactgcaacctctgcctcccgagttcaagtgactcagcctcctgagtagctgggatcacaggcgcacgccaccacacccagctaatgtttgtatttttagtagaaatggggttttgccatattggtcaggctggtcttgagctcctggcctcaagtgatctgcctgccctggcctcccaaagtgctgggattacaggcatgggccaccaagcccagccacagataatttttaaagaatgttgcagtagttaatgtgatcattgaagaacacccttcccaacttcaaaaggactagttaatgctggtgctccctgccccctcatagaactagaaggaactgggattccccagatgaactgaaggaaatacgctaatattcaaagtggataacaatactagggatggctgcgtggatatttttaacatgctaatgtgtacctgccagactgagctcccagcctccaggtgggctggcaatgcaaagtagggttgagaaggaacagggagcttttcagagaaccacagattcagaagcagagggagggggaagaattgaagagaacacagacgcagtgaaaggatgctgggcagatgttagatggcagctcaactcaaccactgcgcattaaagttactcatggagggtactgttcagggcactttaggcatagagggattgtgtaatgatgcgttagcatttgttcaacatcccctctgggatgacgactctgtgccaagtgcttcaaaaacattctttcagatagcattgaatctcttcctacacgagggacagagaaaataaaccagtgcttaagaaagctatattaccttgagaaatgttaacacagtgcttcgggaattcttaggaggaagaaataatggctgacagccagaggttaaatttgagaagaagatttaaaagaatggagactttcttctcatcttctcccccattagatcgcaagttctgttgtactgggaatcctgactactataatatatcccaatgcttagcacatagtaggtggccaaaactgataataatgatggcgatagctaacatatgtggagcaactactgtgtgccagggactgtgctaagtgcgccacatacactgcaccttctcgaatctgcataattacccttgaacaaccagtggcttgttgaagtggcgtgatgttacttcccatacaagtgttctgtgcttgtaagggaatagcaggaaagaagatctcaaaggagaatggtgtcttactgtgacacttttgaatgttacatttggaactttgtgcctagacaacatgggattcagagataattttttagcaacctggtagaaagtcttagagaaggagttggagcagagagaggctgggggcgtcaatacaaattggtccattgcaatcactcaagtgaaaaatagtaaagctggaagaggtaagaggtgagttgcaaagtttcaagactgtatttaaaaaatggtcattccactgatagaaagggaagtgtcaggaagagaagtgatatatttagggagtactgtgttatgtgggtgctttgaaatctcttcttcctgaatgctgagcttgaaaatacaggatcaatgcacatgatcagacgatggtgcagatcttatgctaaagtcttagactctttaggctgtaaagatcttatatagatattttgtctgtcttgctcaggcagaattatcaaaggtctcagaggaatataactcagcttgtttcaaaagaggccttggaagttttctctaacaatttccaaattaattgatgtgataattaataactttgcacttagaagttcctccttgcagctaacctgaattccttgggctgcaattttgatctcatttcctcctggtttatagataggaatgttgatgatgttgctatttcaaatgcatcttctgtaaagatacatttatttaggacttacacccagcttgcttctaaaaaggattagaggcagctcctaatatgtccacctaggcttccttttaaagaagcttttctcattcctgcaaaatgtcttccatctgcatgcataagaagaatttctttaataataaatgatacagcaaaagtaaagctaataacgaactatgctgacaaaatagtaacctgtaaacaaaacaaaacaaaaacaaaaagaaacaaaaaaccacaatcctttcttatgccaggcaatgcagatttttctcatcagaaaataattttgaccaaaactatcaattttaacaccgccagcctctgaattttaagttcctttcttctttgtagtgcctgcttttgccattcttagactcgtgtgtgtgtatgtgtctgtgtgtatttttctcttccacttgactctggaaaaccagattttagtaaagcatttagtgaatattgaaaccaaggtataaatgatggacacagtacttaaattattaaaggtaccaaatgtttgttgcatgaataaatgagtgagtgagtgattgcatgaatataatttgtgattgtaattagggtgttctctttacctcgttgtctgcactttaacgggaacatagatattaaattgaataaatggcaggtggcagacagaaaagacgaaggaattttgaggctctctgcaaagagaagccgtcctggaaggacagtgggcagcatctctgatcagcactacctaaaggaagtgaggagtctttgttgccagaaaccttagccagggccttccctgctcccctccctctgctgtcttagggctttgtttacacagccccttgaagccagctgtcaagggtgcaaacctggtctgccatcctttgaagaaggttcaggttacacatggtaagccacagaacagagaaggcccaggattcattattgtattagtctccacagagctgaacccaggctcctaagagtccgtcccttcttcctgtgtcctctgtcagccagcgccttctgcagctctgatcctttggtcattggtccttctttcctgcacctgaggctaagcctgagtcaagatgttctcaagatccttcctgtttcagctgcatgtctgatgtttacacttgcgactcagaactcacttcactgcaggcttctgacgccccttcaaatccatgcttcactctcacaatctgttttgaatgtctgtttttcctgggtaccacttctcagttgtccacacccagttgatcttcctttcccctccattattaaacatcttttaaatagctcatcactgcagtcttagtaagttcaactttccgtccagctttttatcttttctggtttcaacacctgggctcaaatcttagctctgacatttgattgataggtaaccttaaaaaagttatttaatctctctgagatggaaatttgtcatttgtaaaatgggcaaaattgcatgcatagagttctgatgatcaaaagaaaacacgtatgtaaagcccgtagcactcagtcaggcacttagaaccttgttaaaatgtaaatatccctcctacttaaaaaaaaattattttaagttttgggatacgtgtacaggatgtgcaggtttgttacataggtaaacgtgtgctctggtggtttgctgcacctatcaacccatcacctaggtattaagcccagcatgcattagctatttatcctgatgctctctccctcccccaatccctgactcttaacttttaaaaatgtctcattccttctctctagaaaagtatcgggactttcttttattcttttgcctcctttaaaggcacacaaggagttctctcctctctatagtcatgatcattgtagagacttttcagtctacgcaggcttcctttcaacacaggcttcctttcaacacaggcttttctaaagagtaattatatagcaagaaaccaggatttggtacagactacaatactcacacatgcccacatcatttggaggagggcattcatatcccaatgaaggaacatttttttaaaaactaggagtggtgatctgggactcaatgtaataggcgattgcttgtattagctgtttttttcttttttaaataaagctgatttctaacaaatatttgaaaggtatttagataatttgtagatgagcaagtgataatttttctgtgagcaagaatgactttccctgttttaaacgtgtcgcgtttcttattatattggaaagtgggagtggggagttagaagtatagaggataatagaagaaagtattatagtcaggtcgcgtttcttattatattggaaagtgggagtggggagttagaagtatagaggataatagaagaaagtattatagtcagggaagaatgggacactaccctgggtttatatcactgatcactgaggacgtaaattcacaatttcgtgtggcaggttgtattttcttgttctccctactttgtgaggagcatttgctattatacgttacaatgatacggaggaacaggtaggagaggaacaaaaaagcatttaggcaaaacagagacatttcatactacttagaacagagatgggatgatacaaattgctatgttcccaatacagttcatatctttggggaaaaaatagcgatgctccaatcttcatcccatccccctctttctctaacaagaaaaggaaaacgaggagcagtaggtaggtaggaggggagtgtatgacgtgaggaacaggcaaggacacagcatgtccaggaggagaaaaggggagcaaaaaacgtatacaagataaacaacaacaacaacaaaagagactccagcaagaggctatggttttgggctcctcacgtagaaatcaatgcatttaaaatatccagaattaaagttgaagaagaacactccatctacctcttctcaaattattttctttaccaatactacttccttttgtctttaaactgtgaaccactactctactgtgccttgttcttacaattatacacgtcagtgctgaaaggttcctgggagacatttcctgtagactaaggatagcacctgtgggcatctcggatcgatgaatcatggtggctggagcactgcattgagactggttcaggggctcagtctgttctcaatgggtagggtgatggaatccatcaatgctgggattggctaatgctgtcttccacaggtttggggtgggaggagttgtagggagagccgcccaagtggtgccatccacgctaagagactgagactctcatttacgaggaggttcagagacattaatcaatttgccaaaaggcacacagctacttagtatttttccaaatttaaatttaaatttttccaatttatctaaaacaaacaaacaaacaaaggttcagggccagggggaaaaatgaagattaagaggattaaccatcctgaaaatgaaaaatgatttgccttcaaggcatttagaactgaaaataaatcttcctgaagccttttgttagacactttatcaaaattgctaggagctctgactggctctcttgcaacagcctggaatccttctccccagtttcagaggagtttcaaaatctgtaatattatagactgactatttcttccagggggagaatttttcttagtgcttggataaagagatgaagtattaagacactttaaactattattcatgtaggattaacagatatttgaatttaacttcagaatcttttaaatgacaccccacttaatataatttttaaaaagttctttctgcagtgtatcaaataaaagtcccagatgggatttggacttggttttaactaatcatggtagcaggcagtagtctcagttctagaataaatggcactccaagtaagagacttaagttcttcatcagtgccaggctgcaacaacatgctttgagggaactctggcccctaaatgtctcctctacttgcctggaaatttactattaaacattcagaatttttttgaaaatgctaatattcttgggtgatacgccatttcaaatttattgttagctaataagtaaggaagaaggaaaagctagtgatgaggtggagtgatttgttaatagctgtgggataagagaagagagtgaccgaaataatagttttccaagagtagctacaggaggggttttgctggcccaaagatggacttcattgtctcaaaactactcctaacaccagaatgtttaactgaccttaggccttatatgtctgaggacccaataactaacactaagcagctgatgaaaaaccacccacataaataaaccctcaagatgccttcggaaaatagaaaagaaaagagaaaaacaatgtaagaaagtgtaggagtgccttctcttcaacatttctgagagaagatgggagttgaaaaccttaaacaaaatgttgccccaatctcacttgcctaattttagttatcttggttcagggctatgattcatccctaaagctgtgaattactgaggaggaaggagggaaaaaaaaatcgacttaaatgtcaaagaagtaggaacataaatatagttttcttttttgaggaactagaattccaggatatagggatcttttttctcataagggactgaatccttcaaacttctagaaaaataatgatctgcagtcaaaacatcatcaaggaatgaaagacagaattgattatgagtcatgtcatgtctgaatttttgcctctatagtgtattttcctttttttcttttgtatctctttcaatctggttaaactattaattaattaattaattttgagacagggtctctctctgttgcccaggctggggtgcaatggctcaatcatggctcactgcagccttgacttcctgggttcaaatgatcctcccacctcagcctcccgagtagctgggactacaggtgcacgccgccacacccagctaatttttgtagtttttgtagagacaaggttttgccatgttgcccaggctggtctcgaactcctgggcccaagcaatctgcccaccttggcctcccaaagtgctgggattacaggtgtaagccaccgtgccaggccaatctggttaaactagaggtcactaacaattgtatgcagttgaagatgacggaggtttaatgtgtagactgtaatgacaaagggaactcataaaataggtgagtgtgaaacgaatggaggtaagtggaactatgagaaatgattctaggggatgtgatggtagcacagggaaggaagatatgtttgaatggttgtctaaggttctcttgtgatccttttgtggatcataatcataatgattgagttttcacagtaatatatgagatgtgcttccttcaaaccttgttatgatgttggcacactatccgtcttacataaacataggaaaaaaaagttctctttcctgccaaagaacaggggacaacagaaatggtgtggggaaactccatcctaagtaaaatgttttcaatttagtaggtgttctcctgtccatttatcaccactttgaatttctgtaagtggggagggatgaaatagcagtcactaactcatacccagttcaacaacttcaccgtctgaaggagctgaccctctaccatcagcctagctgtcatctgcatgtttgcctctttctgctctgaaaacttctgagcagtaaaagaaatatatggtggtcacaaaaatacggtccaggacgttggaggagggtcatattgtgaagaaggcaaatgagaaagaaagagtttcaatgacttcagagtgatcctccacatcctgaagctatgagagtagcccagggcacaattgtgacattgatttcagcccctaccctctagccctgtcctcagtctcctcagagcactcttctcatcttcctcatggctctacatctttctgttctcctcttacctgggtattgctgtggacaagagcaattcctctatcttatcacccaagacccaaagtgtcactcagtgaatgtgaccaatgcatcttgatgacaacctaacgggatacttaggaggtggaaaggactctggaggttgccggtttaagtgactttcttgcccattgcaatccttttcttgcatcttctggaagatgttaaccctatggccatgactacctaacattgtgtctagtggagagatattttaaggtccatagaagaatttttttttcagaagggtccttggcctccctcatttcatgtcaccttggtccactgcctttcttacaaatccagttcttctaatttaattttctgagcttctgctaggcgcgccaaagtgcaatgaagacttgtttctgttttttatttccacgaatttttttttttttttaccttgtgtggcaatgttttgggtccaattctgttctccaaatagatatattgaagtcctaactcctactatcggtgaatgtgaccttatctggaaatagagtctttgtagatctaatcaagccaccaagtttgtggtagtttgttctgatgattcttgaaaagtaacacatgtagtaataaaggcaaagaggaagggcaactggaagccaaagaaagaaggaagaggtttttttcttggcttaatttactgatgcactggtattaatttttgattaaaatgatccagaattgttccacatgaacccttgaaaaataattcatgggaggccgtctctgtccggatctttaaaatacaacatactctgctatttaaataaattcccatcgcacaatagtcagctgtttttcagtgctcttgattaacaattgggtttgttttccttaactcgactgctttgattttttgttttattttgccttttaatattttatttagtaacataaatgcatgaatagtaatgttcatttcatcaaaatatggaatcaaaggcacttaaaaatacgaattatccgtaatatatttttcaggtccaaatggaattctatctatttctacattccaagactctaaagaatttactctctataaacagcatttagaatgaaatcaggtcttgcttaaaataatcaatctcagtggtttcctgcgtagcgctattctttgtttacaaacagcacaaatacagttaaggactacagtcatatgctgcacaacgacatttcagttaatgatgcatataatatggttgtcccataagattataatactgtgtttttactgtatttttctatgtttggatatatttacataaacaaatacttaccattgtgtgagagtcgcccacagcattcagtacagtaatttgctgtataggtttgcaacttaggagcaataggccactccatatagcctaagtgtgtaataggctagaccatctaagtttttgtaagtgtactctatgatgtgtgcacagtgaaatcgcttaatgatgcatttctcagaatgtagctccgtccttaaatgatgtatgactatatttatatttgcaaaacaaaacctttttaaggccttcaattgtaatacatatcgagtgcccaaatttaaaaatgtatgtcaagaaccttcacatatccaattttaaagcacggtcacactctataagcttctctaagacaatctcttctattatgttactcaattatctgaaaaattcaagagtcttaagaaaaagttcttgtgtgtacttcgtgcctgagcaaacgttcaagaattgggatacatgtatattctcattgaccagaaatttcaatccttttcagaagccattctggattcttttaaatccagaatggcttctgaaaagatgggatttcttctgcttcttagagatgaggggttcagcttatgatcaatgcagaacacatctgttgcctctctctacaaagggactggggtacggacgtcagatctaaagtcacaatcaatgtactgcactgctccacctgtaggatgtttctgccccacttactctaggagacacaccatctgagcctcggtgataatacaagcacctggactatcgcaagtgcagggttaggactactcacttgagtgtggtgagttctgtaagggatggctgagtagccttgagatagctttctctccgcgcagcaacttttggagaaggcttaggactcgtgtctgagtctccactgtcttcatcccccatggccttgatataactgccactccgcattcttcggcatggaatttcatcatctttacctcgtggggtgtaccctgtccattcatcttgtggaacctattcagatagaaaacagataaatcactttttataaaagcctacctttttcttttctttttctttttttttagatttaacatttctattttttttttttttttttgagatggggtcttgctttgtcgcccagactggagtgcagtggtgcaatcttggctcactgcaagctctgcttcctgggttcatgccgttctcctgcctcagcctcctgagtagctgggactacaggcacctgccaccacgcctggctaattatttgtattttcagtagagacggggtttcaccgtgttagccaggatggtcttaatctcctgacctcgtgatctgcccgcctcggcctcccaaagtgctgggattacaggctaacatttctaatttttatgagtacgtagtaagtgtatatatttatagagtacatgagctattttgatacaagcatacgatgtgtaataatcacatcagggtaaatggggtatccatcacctcaagcatttgtcatttctttgtgttacaaacattccaattatcgtcttagttatttaaaaatgtataaataagaccaagtattttctttttttggtatggtgctggatattggtaatataattatctgaaactttagacattaacctttcaataacaatattttattgtaataggctcataaatattttgaatatgtacaaatccacgtctctcagtctttaacatgactcatgtagtaggaaaaattaaaaccattggctttgaatcatttgtacatctcagttttctcatgctgataatagttgagtcaggcataagaatgccatttgaaaggagagcaattttatttgagcttttcagtgatttgttttcaattgccatttaagattcgggaatgtttactgattgatctatgccttccttgaacctttcgactttaccatctcatatccagtctgtcttcttcctaaaccagtggtctctaccagctgcatttactccccagtcacttattctttctgaatctttcttaatttggattcagcttccttagatctgcttaaagcactctctaaaggtttccaatgatctcctaatggaagataatggcattttcttgcttttattttttcttggcctctgcacacccgtgcacacacatacacacaaataacacctctttgcaagtttctccccttttggccttctgattgcttgacttacctggtgtagctactacttgtctgaattgttcctttccttttgctttgctggatcctactctaagtccctaactgtggataccacaacaaaatcatattgtcagtgcactgctcttcttttttctttccacagtcattttttctgagttcagcagagcactgcactacgttttagaagccatcttcatgactttctcttcagttcctcttagattttccacttcaacatgaactcaacctagatctcattccttcttcatttttcatgacgtgaaaaaaaatgcataataaccactctttttattcattaagaagtaacatagcaaacatactatagtggacagagcactgcacaaggcttaagtaaaagagaccaaaaaacggggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcatttattaattatgctagtaacaatgtaatgtttttacttttgtaggtaaaagcatcaaaatcaccacagcaacaaagatttctcaggaaattataaatgctgagaacagtcttgttttccttgcattggcaggtgactcactgcatagatatgatcatcttcagagcctcattataggtttagcaattacattttaaaaattaacttggtacagctgagggtcatagatgacgcacaccacacttgctatttctcaatcctgatgtgaagttcataagcattgctctctggagtatgtcagagactaatgacaaactgattagctcatatggcttatgcaacaaaacatggcaaattttgttcagatatttttttcaaagttagtttatggtagaaatttgggctcatactagaaacagtctgtaactgttgtttagggaaccagctgagaagtatttaacctgtgtatctttcaattaatcttacttttcaaatgatagcagctaagaagttatgtggaagtgacttccattggagtggaatttgaatagtaatacattatttatatacctaaaggtagcatacaacaagattacacataaaataatacagtaatccgttctagggaaagtgtaaagacagaaaatcgagaccttggagaagaaaaacacaactgctgaactgtaagggccattaacatcgatataatcgagtcagtttttagtttttgtttcttaaaccctaaagcaaaagggagacattgcttaggtagatagttttagaagaaagcatataaagtgataagcataccaggcccaaagagtgaaatgttactgccttttgattgtaaagaaagggagaattacatggctgcagctgctattgtgagctgggcagaggttgctgtgtctttccatttcagctgcacagagagaaaagatttaggaaaatccaaagaaaaagataaccttgcagctgtctctgaaaagcctgcgttattactgtggtggcagtttcaggagctggaagtcttggtagaaggaaagctggagcagagacaaagagtgcaggtcctcattgatttcaggctggtgggatgccctgcttgtgtgcaccagcttaggagggggttggactcaacaaacataaacaaataataataaaagcaaactaatacaggttagattttatagtagttatggatgagaaaaaaggattaattgctttttaattattatgtttaagcattagcactccaacagagatcttaatttttgatgaaacaaaatgaggattagtgtgcattgtctatttcagtggtagcccgtctataactgaaaccatatgttatcattcagaaaactggaagacctgcccttgactaagaaatggccataatcaagtgctaacatcctctaattacaggatagggatgtagggatggtttttttttttttttttttttttttttttttgagacagggtcttgctctgttgcctgagctggagtgcagtggcgtgatcttagctcactgcaacctccacctcccaggttcaagcgattctcttgcctcagcttcttgagtagctagaattataggcctgtgccaccatgcccagctactttttgtattgctagtagagacaggattttgccatgttggccaggctgctcttgaacatattgaaagaactatttcaatacctttttttttttgaggtggtgtctcgctctgtcaccaagactggagtgcagtggcacgatcttagctcactgcaacccctgcctcctgggttcaagagattctcctgcctccctagtagatgggactacagatgcccgccaccatgcctggctaatttttgtatttttagtaggattggggttttgccatgttggccaggctggtctcaaactcctgacctcatgatctgcctgcctcggcctcccaaagtgctgggattacaggggtgagccaccgtgcccagccaggatgagaatgctttctgaattgaaatgatgtcactgcactgaaggatgggctctgctggaagtggagtatcttttggtgctgacatttccccccactttaggttttcctaaactcagttgaaagaggaacacacggccggacgcggtggctcatgcctgtaattccagcactttgggaggccgagacgggcagatcatgaggcaaggagttcaagtccagcctggccaacatataaaaccccgtctctactaaaaatacaaaaaattagccaggcgtgatggtgggtgcctgtaatcccagctattcaggaggctgaagcaggagaatcgcttgaacctgggaggcggaggttgcagtgagctgagatcgtgccactgcgcattttactgaatctaagatactaatgcaattgtcccaacattttttgtgtcactaagaaagaaataaacatcatcaataaattctgacactccatagaatatataatttatcccaatatccaaaatgctaaaacgtgtaaactatggctcttagaatcaattaaaaaccttttaaaaatatgtatgagaagaaaaacaagaaatgaatttattctgggatagtaattgttgaacttaatgttcatatttagtaatgaccaaattaatataagcaattacatttatcatgtcatgagtttggaaaaaaacataagttcacataatgtcttatgatccttacaactatcatgaaggatatgaagagtaaatattataacctcagtttgtcaaatagagaaactgaggtcaggagagattagtaactagtgtagggtgacactgcccaagctgaggtctgccattcacagttcaggaatctcccccgcccccttctagcatattcatatatgtcttttgacatgtcttttgggtaacaattgttattttttgataaactacaaagcacatattttagataagaaaataatatcatagtgttttaaggtctgtttgaaggaaaaaattaataaacaaatagtgggttacaaccctttgaaagaaaagttacaagaactactctatcagatgtaggaacgcttagttttaaaagtctctccccaagggcatctagcttgagtgccccactttggctgggctgcagttatcaaagtgtagctaaatagattacagtctgtgccaatgatggtctgtgagacgatgattgagagatgaagccatgtgcacgtgactctttgagagcggattatctcaggatgggaagttgcatggtgaggtgtggagtaatgagaatgcgtgagattttgggaaatctgagagccacaaaaggaatgaagacacttagaaagccgggacagctgaaatgaagcatatgtcctgaaaatatacaagggcaggcctgtgcgattctgtgagctattctgggttgcagagatttgggaggaaaactgatgaacccaaggctgtgagtacataaagcaaagttctatttcatcaggaaccaaagaactgggaggaaggaacctaggcatttggttgatttggtgaaaacaaaggcagtagagcaaggaaaagtagcaattgaatggtgggcatgagggataggcttctatttgcacagttacccctcagcagctgttgattccttcccaagcacaaggtatttcaatgacagcagccaggtaaataagggtgcttggcagtgacttagggatcaacctgtttgactttcctgtgcttgaaaaggaatggtaaataggaggagaaaaatgtacattatgaaaggagagttgggcatctgacattcatgaaaaaatctgacaattatggaataatctcaatgagctaggggcagtgcctatgttactttatgttaatctttgcagcagttgtatagaataggcattactatttccatcttactgcttcaaaattgagattcaaaaaggagagttaggcatctgacattcatgaaaaaatctgacaattatggaataatctcaatgagctaggggcagtgcctatgttactttattttaatctttgcaacagttgtatgaaataggcattactatttccatcttactgcttcaaaattgagattcaaaaaggtaaaatgcaatggctcatgcctgtaatcctagcactttgggaggccaaggcaggaggatcacttgattccaggagtttgagaccggcctaggcaacatagcaagaccccatctctacaaaataattttttaaatgtagctggtgtggtggtggtatgtgcctatagtcctagctatttgggaggctgagacaagaggattgcttgagcccaagagtttgaggctgcagtgagctatgatggtgccaccactctccagctggccgacagagtgagactctgtgtcaaaaaaaaaaaaaaaaaaaaaaaaagatgaaacgacttgcccaaggtcataataattggtagaaatgtgcatttgtctgacatcaaagcttttaataatattaccttgcctctgatgaatccgtgatgattaagtgaatgaaccaataaactaaaaaaaagaagaagagaatggggtgcacgctcccactcaacagtcgtggtttttaaaataaaatgtaaccattcaaataagcataaacgttctcgtgtcactaattttctagcactgctaaaagagggttcaaaataataaacacttaattctgaagtgaaagagtgttgttgtttcctggtctggggctgccttaccaagtattgtttgcagctgctgtttaaacaagcatgaacagtttggaggagggagtgggtgattagaaaacttgcaggacagccacacctttaagggtggcttgggagccttgaagcatcccaacagcgttttagcatttgtaagaaggctccaccctggactttaggttcctgcctacaactttttagagaaatggctgtaatgtgttggccttctaagcacttttagtgggctctcagattccctactcactcgatttctttgcatcttctttgcagctgggagaactgcttttctgctccacacagctttcaccttgacaaatgcgacttggcttaaatgtccctttagcctttttagcttgctcttctcatagcaaaaacagaaaaaaaaaaaaaaaagagcaagaataggaaaattacaattatgcaatgtgcagatccctaggcatgattgttgcttcccaatcaggagaagatttccctggcaaccgccctttcttactcccctggaagcccgaaattggtggaaaacttaatttgttttagattgcttaaaattaccttttaaggataagagtaaatacctacctctttaaatagaatttataccctttgtcacagctcttccaaataacatttttaaatgatcttgaaagaatagaacattgtaaacagtgatacatacggtaatttgcttaccatgaccctgtagaattattcttacccacaaacatttacagtatctgcagggtacccagcaccatagcaggggctgggtaaatacaccaaaagcattttataaaacacagtctctggtgttaaaggagtttataagttttgagtggatctggtgaatctggagggtggaggaaggaaacgagtaaagagcagctttaagtaagtcaagctgagtcgagtattaaatctcagtacctctgaatttcctactgggtttgaagcttgttcccataaatcccctttcctggtgatgaaactgttccttaaaaattgaacatatgtgtgtgaagtgcaaatgccactgataaatagccctgcaggggaatggcagagggcctaggtctgcagtccccaagggattggggagccatgggcctttggggactagtagaaaatgttactgaggtgctggatgacatcaaaaggggcactaactgtggataagacactctcgtgatatcacatcaagaaataataactaagatgctgggtgtggtagaatgcacctgtagtcccagctacttgggaggctgaggtgagaggatcacttgaatccaggagttcaagaccagcctgggcaacacagtgagacaagatattaagattctagtatgatgtagggacaggaagggaaatgaattttattaattattcacccactattttgacggtagtgaatacgtataggtttagctatcccagttccacttctggttcttgtagccaagcctcctgattttgctttgggaaaagctttctcctcaattcgaggtccatgtatttcaggagtagcccaagagttggggtaggacaatcagcaaatcacacttcctggcttcattgcttggctcagggcagaggtgaatgatctaagcttactcagtcagcaagcatctctggacctgtgcatgaaatgccaggacaaagatacctcctctctcactgaatatattaatagggatgcatgtgaccttaggacttgtcggtagccattttataacatctaatacacaaacataatttcacgtaatacaaaaaccttatgttatcttaatgccattgcaatgatgaaaaaattgagacttagtggtattaaataacttagaccaaatgttacagcttgtcagaattgaaagacaggtttgtcttactcaaatttctacactcttcttcacaccaggctgctgtctataagagtttcaaaactttgttatagtaattttctattaaacctaaaattcaagtgttaagttgctgagagatacaatcccatagcattttggaacttgtaacaagtactgagtgttagatgcttggcccagcactttgggaggccgaggcgggcagatcacctgaggtcaggagtttgagaccagcctggccaacatggtaaaaccctgtctatactaaaaatagaaaaattagccaggcttggtggctggcacctgtaatcccagctactcaggaggctgaggcaggagaattgcttgaacctgggaggtggaggttgcaatgagccaagatggtaccattacattccagcctgggtgacagagtgagactccctctcaaaaaaaaaaaaaaaaaaaaaaaaaaaaatagaggtctaggtctatggtaaatatattttttccactgactatataggagataagctaacttagagcccctttttagtttttaagataacttcattttctggtgtattggaggcatatctgttggcttggaattgttagttgagccatcatagctttccattattgttatagttactagtgtgctggtgtctatccaccatatcctatgatgtttgtggctataattcctagttgcaaacattgaattccctgaggcaaactagaattttgtgtctggtgttcagaagcagagatgtgggtagaagattagtgaccttcctcttgctgccaatagaagcccacatgtggaaacatcattcatcaacactaatccttggtgttgtctaaaatcacataaacctctcagcacatctgtctgttgctatacacacccaactacttgtcaaacttgtatattaattttttccttaggacacaaaatctgataatgttattattaacaaatagtatagctagagtctataaaatatcaagtcaatcatctcaagtattaatacttaattttaaaattaaaaattttaaaaaaggtttcggcaaatattttcctttagtctattatcaattttgaaatattaagtttcttaaatgaggcttacttgtgaatcattaacttacatatttgacatttataaacaaagaaaaatctcaatagatttaagaagagacacaactcagagcctcctgcttctcgtcatcatcatctgattcccactgcatcttggggctgtttggactttttattccaagctacatttataacacctgaaagcatacggcattcaaacgggccaaaataatctttccttcctgaatcccatccattctaatgcaatgaaaccgtcaaaccacatgcatctagttcttgagatcgggaaaataactgaataatattttggtgtcctcatgcacatgtgtgattcaaaattccactttcataatcatcatacagggaagttgcctcttgagggtgtgtactttaagctacgtttcaatctactttccacaggcagcaagatatctataatgaacagaggatgtcccacaaacatgtgtacagatgagtatgatacactcaatagttatccaaatcagtgcttccaggctagctcaaggtccattgaaaggaaatgttccaactggagtattcattacagggttctcttctttcactttaaactgattactttgtggttaagctggagttaaaagttccacttcttctgtgactttatcaaaatgctttagaagtattcattcacttgttcaacacatatttattgagtatatacagtcatcctatggtatctgtgggggactggttccaggataccaaaatccgtggatgcttaacttcctgatataaaatggtgtagtatttgcatataacctatgcattatcttcccatatactttaaatcatctctacattccttgtaataccaaatacaatgcctgcacatcacttcatttgtgtggattcaacatagtactcagggttcagcaaattcaagttttgttttgtgcaattttgtggattttttttccaaatatttttgacccatggttggttaaatccacagatgcagaactgatggatacatagagaggactgtatcatgaaacaggtgctattttaggtactggggataccgcaattcacaggcagagaaaaaaatctccgttcctcaaagaactaaaaatagaactaccatttgacccagcaatcatagtactgagtatatataggaaaataaagcactctaccaaaaatacacctgcactcacatgttgatcacagccctattaaactatactaaagtcatggaatcaacctaggtgctcatcaatcgtaggttggataaagaaaatgtggtacatatacactatggaatactatgcagccataaaaaaagaacaaaatcatgtcctttgcagcaacacaaatgcagctggaagccattatcctaaatgaattcatgcagaaacggaaaaccaaatactgcctgttctcacttgtaagtgggagctaaacgatgactacacacagacataaagatggcaacagtagacactgaggactccaaaagaggggatggtgaagggcaagggttgaaaaactatctactgagtactatgttcattatttggatgatgagttcaatagaagcccaaatctcagtgttatgcaatctatccacgtaacaagcctgcacatgtatgccctgaatctaaagttaaaaaataaagctctgctgtcatgaggaagggaaaggacagacactaataaaatgggcaaaatgtatgttaggcaatgatacgtactatggaaaaatgaaagcaggaaagggggaagactgtgtggaggagaggtgggtggtgggataggcatgttaatagtggcatcatcgcaggctacattaagagacctctaggtaccgactgactggagtcagggactctgccctggggtctggtggcagagtgctcaaggcacaaagaagcacagatgagaaagtcctgaagaaagggcaggactgccatgcacacagcgggaggccaggtgagtggagtggagtgagaggtggcagaaggtgaggacagtgatttggggagtgtgggggtccatttcaggaggctttacaggctgtggtaagggctgtggcatgtacttggggtgagatgggagtagaatggaggctttgatgagatacagacacattctagttcaagagaatcacgcaggttgctaagttgagaatggctcaagggcaacaagagtagaatcagagacccttggaggctcatgcaataacctagattgtagctaaaggggaggagccagggcagagcagcggtggagggagaagatagggccaagaggtttgctaacgatgatctggatgtgtggactgagaaacagtagttaagggcgactccaaggtttttgacctgatcagctggaaggactgaattcccattagctgagatgacaaggcctaaagaaggagtagactcaggatggaaattaggagttcagtttgggatgtaggaagtttgaaatgcccatgggtcatctaagcagagatgttgaatagggtagcttactatctaagactggggcttcagggtggctgcaaacatccctgtgggcatacacctgggacttagagctctgagaatgaaggaggtgacctaaggagtgagtgttggtagaagagagaaatggtccaagagccatgtccactcagcattgctccacccttagaagtttggagctaagaaaccacaaactaggcaggcttaaaacgatcaacaaagggtgtgttgtcggtcctggaagctgagtgaaaaaagtttttcaaagagaaaggagtaacgtactgtcacattgacttcttcccgtgatcttaatcccatgggacactaagtcagcaacgttaattttatctcttagtctcagttgccatagacaaaggattctgctgttcatgaatagctttatcttcccagcaagatgcaaacttcttgagagcaaggcttttgttttcttctttttctctctctctctacagcagtggcttttaaatagcttttggctacatctcacagcaagaaatacatcttactttggaaaccagtataagcacgtatacaagtgaaagacagagagaaatacttaaccttttggcatgccacacactgtctttattttcattctcttctgttgtattctatttaattaaaaataatggtgtttgtgacccattaaattgatttcactaccactaattagttgctaccattgcttagaaaagcactactgttagagtgtctgccacagtgctctgccacattcattattaatcagagagacactgttattcatcttcattccttctcaagtaccttctataaagcaagtacttaatagatgcttgccaaatgaatagttttgagaccctaaagtaatacttcttgaattgggctccttggtctttagttacctttacttttactgattgtacttctgtactgattgtagtcgtgtagaagaatatttcttaaaacctctgtgtcttcagaataaacacagacctgcatgtctttttaaagaggtccctgtgtagccaagagtcagacaaaacaccagccagggttggagatgacagcccagatgaagtgagtccatcatctgggttatcacatgtgcaaagttagggcaagaatcctgaagtttgaatgctttttcatgttcttgtacatcagcctctgggggccaggggcagtggtgttcaaaacatttttaaaaacaagacaggccaggcacagtggctcacgcctgtaatcccaacacgttgggaggctgaggcgggaggcttgcttgagcccaggtgtttgagatcagcctgggcaacagagcaagacctcatttcaacaaactatttaaatattagttgggtgtggaggcatgtgcctgtagtcctagctacttgggaggctgaggtgagaggatctcctgagcctaggagctgaaggctccagtgagttgtgatcaggccactgcactccagcctgggtgacagagcaagactctatctcaaaaaaaaaaaaaaaaaaaaaaaaggacaaaaagacaaaacaaaacctttaaaaaaaaaactttcaagaacaatcccatctttttattataatttacatagtattcaatgtcaatatgaaatattgattatttaaaaatgggagtagaaatctttcattaaatatctatgacccaaagtcgatggagctgggaaaatcattagtactaacaatgtcttagaattttgaaatgcccaactacagaaatgatatataatttaacccagacatttcatttaaagaatctttaaaataagagccaggtacatggtaaagtcctcaataaatgttagctaatgtttaaatccttctctatagagaatgcttataaaagtggcactgaagaaaataaaatatttttccaccatgtaattcttacttaggtagtttttcacttataaggaaggaggatggtgcaatgaatacagtacatcaggtcaacctgagttcaaatctgactctacttagaccagacatgtgattttggcctaattacctgaacatcttttaacttcaggttttcaaacataaagtgaggacagcaatacctacttcagagactgactataaagatagagatgatataaagtaacatatgacatgctaactcattcaaagtgtatttgtaggttgctttttcatatagtaatcatgtttaaataacggttaagttcccacatggtgcaaacccttaaagcttgtttcattcatgatagagctgacccttaatggattgtgcaatagatccaagactctctgagcttgggggtgggagggggtggagggtggggaaggttagtacacttgggggaatctctagaggcctgtgtataggggactgtggatcagtcagggttctcagaagagaacaggaaaaaaaaagatttattttagagatgactgtggtgagtagcaagtctgaaatccacagggtggtctggcaggctggaaactcaggctggagttgattctgcagtcttgagacagaatcttgtcaataaaacctcaatttttggtcataaggcctttcaactgattggttgaggcccatccacattatggagggtaatcttctttacataaagtctactgattatagattttaaccacgtgtatacaattactttactgcaacacctagattagggtttgattgggcactgggtactctaaactcagcaggtggctgcacagaactaaccatatagacaggaattcgggtgggcagcttctgaggcagtgggagggagacttgatgggcagacagggccgctgcagtgcttattgatattcagattctcttcagctgtgagctgcatatgctccgttcattttctgaggaactatggtttgggtcaaagacgtgagtgtaaagaccatctcctcactggttgttcaggagacccacaaaggccatgtaagcaaagtgagactcttactggctctgtaccagcacctagcaaggtgcctggcatgtcaatttcattgacaatgttctttaagggcaaaagagtcattcatggaatttttatttcttgttgacaaatgaacaggaaaatctacagtcacctgaaacatcccaccatggtaaataaacaggaaattggccaggcgtggtggctcacacctgtaatcccagcactttgggaggctgaggtgggcggatcacgatgtcaggagttcaagaccagcctggctaacatggtgaaaccccatctctattaaagatacaaaaaattagccgggtgtggtggcacatgcctgcaatcccagctactcgggaggctgggggcagaagaataccttgaacccgggaggcggaggttgcagggagccgagatcttgccattgcactccagcctgggaaccagggcaagactctgtctcaaaaataaataaataaacaggaaatttatagactcatcttttatttaagccctttgtattctgaaagacaaagaattccataatgcccggccttgataaaacaaatatagagctaaccttaaaaaaatcaagatttactgtagcaacttgcacatactactaatgtaacactgatcacattgttttaaaaccatttgtttatagatcagtctcacccaccaatctgtaagcaacttgagaggagggatgatgtcatttgtctggcagagaccaatattcattcctataattctagttctaagcagagtataaaagaaaacaacatattgtaaagtaaaagtgctcatgaaatctctaattacatcactcaggttgtacctattttattcaactgagaaataaagtatggacacctttcatcccagattttcctctaccaagggcagggaagaaacctcgcaatggttgtgggcaaacagggatcatggaggaacacatctccgtgcacgaagttgctggtgcatgtgtgtagagggggtatgaatgaccagtatccagaagagaggctcttttggcatccaaggagctgcagttggatgttgctgtggagatatttggggaagcaaggccacaacccccagcagggtcaactgaactctactaggcccagagagacccatcaccagatcatggcaggacgagtcaaacagaatctgaagactgtcatctcaccctgtgtattccaaagcacattttatggatcaccaatccttttttttttaatactttaagttctgtgatgcatgtgcagaacatgcaggtttgttggatcaccagtccttagaaatgttctgtgaaatgtggttccaagagggtttgggagatgctttatactgtattgttctcttaaagagtttccatccatatgagcatcttaaagattctaggatgtctgccaatatagaattctgaatacagtactcagtttctcaaattcaactccttttcttcacattaatatctattcaaatcatcctttgggaaatgtcagcttcttcacatacaaacaaagaaattgacatccagaatgtaaattacagcttatatggctaataagtggcagaactgggttagaattcagatctcctttggcccattgcactttcccagttcatcacactgcaactatttatctcaccactgaactcttcatgaatacctttcaacaaattctgtgaaactgttttgatctccctatatcaacatgtagaagacaaacatgaaggaatggctactgtgtataggagggactcagcctttggaaacttcatattttgtgtcaagcctgtgccaggatatgtttcattcaagttatcagtgcaaatgagaggtggtaatagagacatgtaagtgacatggatctatacaaataggtttgggtcacatcttgtattttacaccaagaacctagatcatgccaaccttttgatggtaaaaactgtaatgagagaagaatgcttcgtcaagataataaatgattacctttgcatatagaaataaccagaacccatgcatgcacactccattattccttctgtctcccgacattgactggaattcagtctttagtatcctctctctgtcacacacacatgaacgcacaagcacacttcatattcagtgatgatgtttttcctattacaaaaactgtgaactacccatggacagtaataatgcagatatatttcatttgagaaaggctttcttttgtcattttctttctttacctttttggtgatgagtcaagctgacctgctgggtgagatggttcagatattcatgcttcctcctagtaacgatgctggctttctgcaattcaaatgacccactacagctgcacgagtaggcacttagccacctactccagttagtaattattcgtttagactaaaaaattctgaatcaatagaaaaacattgaattaagcctcatttttgatatctcatttgacaaaggaatcatgttatttttccttgcagtggatttagataaacatccagaaaaaaaaaatgttttgtgttggaacggccacagagaaccttctttttttttttttcccaggagggaacataattctaagtcaggaaaaataatttatgtggcttcctagtttctgcccaaaccagccatatgctctcaatattactggaagaagtctgaaacagaaaatacaaagtaggggcaagaaggcccttgtgggggatgcaggggtggaaaacgggaggcagcttaggtgccccccccatcactgaggcagaggagtgagagcacctttctcctttgtacacccacttgtctgtcaactttcctccttccatttgaggctgctcctggatgtaaattttgacctgctttcagttgtaataaatacatgaggcatagaagtaagagaagctcaaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacaggcacatgccaccacgcccagttaatttttgtatttttggtagagatggggttttgccatgttgcccaggcttgtctcaaactcctgaccctcaagtgatctgcccgcctcagcctcccaaagtgctgggattacaggtgtgagccaccgcatctggactgttttgttttgatttactaaacagcttttatttttctcttctgttacacagaaacaaacaaaaagataattattttgtttgggaggcatttgggtatcatgaaatatttaaatcagagatttctagcacgtgtgatcaatgaaaatagagggaaactaggacttctgaactgatttccttttggagcattctcatagatgaatctacaaggatacaatgatttgtctgaatgataaatttacctgaataatttatctgaatgataaaattttgatacctttattaagatacttgaaggtgttggtttacaaaagattaagtaccacagtgtaaaaattctattgttgcattaatttgattagcaatgaaaaactcagaatccatttctaaagaagttgataatacaaataaaacatttacctaaagactgactatacacaaataatttctgcaatttatccaactcataaattggtatagagatttatgggccgggcgtggtggttcacacctgtgatcccagcactttgggaggccgaggcgggtggatcatgaggtcaggagatccagactatcctggctaacacggtgaaactccgtctctactaaaaatacaaaaaattagccgggtgtggtggcgggcacctgtagtcccagctactcaggaggctgaggcaggagactggcgtgaacccaggaggcggagcttgcagtgagccgagatcgcgccactgcactccagcctgggagatagagcaagactctgtctcaaaaaaaaaaaaaaaaaaaaaaaaagatttatgtaatagatgattaatcatagcactggttgtaaaagcaaaatgcatggtagtgaatactgttccccaatatgtattgctaatatactagttctttaacatgtgatgttaatatagtacaaagtagcttcattaaagaaagagttttgatttgattcaatcctgtgttcccggtgtctggaagtgagcttggcacacagtagatgagcattaaacatttgccaaatgaatggacactccatataatcaaatatatgtacataggtgaatgtgtacgtacacatatacatatttgtatgtttgactatatgtagaaaatagcagaaggcgaatgttaaaatggtaacagtgatggctgcctttggttaaataagactggaacacggtgggggagggagcttttacttttaaccctgtatcaatctgtactatttgaatttttttcacaattagcatatgtaacttttattaaaaaatgaattctgtgaaagaaccccaaatgtacgaccactggagatctgcattttagaatttgtgttgtctttacattatctcaccttaaagatacaactccattatgtacacgataacctaaggaacaggctttgactggaaattgatgaaacttggaccacagaatcagaaattagaatcttcaaagaatcgtcattacagattatattttgcttttccatttcttcagcttcaaccagaattttatattcaaagttaagaaaatttacatgtaactgtatgcaaaaacccatatggcctgtgtcagtctgtaccacttattttcaatgagataaaatagcttatttaaactttgaattttcccattgggtttagatgatttagctgtttatccagcagccctatacttaaaaatagatgagatgacatttgtgggttctttaaaaaaataccctttggagaaagaagcagaacactaatgccatatttaccatttacattatataagaatggcaagtttttatagaatgagtgcttcatagaaaatatcctcctttctggccaggcgtggtggctcacgcctgtaatcccagcactttgggaggctgagggggcagatcatgaagtcaggagatcaagaccatcctgggtaacacggtgaaaccctgtctctactaaaaacacaaaaaattagctgggcgtggtggcgcgcgactgtagttccagctacttgggaggctgaggcaggagaatcgcttgaatctgggaagtggaagttgcggtgagccaagatcgcgtcattgcactccagtgtggcaacagagcaaggctccgtctcaaaaaaaaaaaaaaaaagaaaatatcctcctttctaacataaaagctatagctcttctgtaaccagtcacaatcattgcatatatgagggcatcccacataagtttcattatttgatgattataattaatttaatggaaacataaacatggttggaaagtttccaataatagcataggaagatttttctctcccttctcccttccaattatgtagtgcctccccgccatcgccatcattcttttatcaattatttattgtgtgtctgctatgtgggaggcacagttgttataaaacaaatataaagttgatgttgactatatttaacttgaccttatatacctatttaataattatagcaacctgccaaaaatgagaagtgattaatattagccctaaacctgctgtcatacgattccacagagttcaagataagaattaacataagttaagctgaaaatatactgtcacctgaaattgcaaactgggtaggtatacaggagaacgatagtcaattaaagtatgaaatattcaaatcagtgttccaatcttggtagcattgctgatggcaaaggatgatgacaccaggaggaaatgaaagcaaacacatcactttcctactcagaatagtacacctatcttaggatcttactgattttatttattaaaaaaatacactttaggagaaaagtgcatttatcgggtaatatgaaagaggaaatgaggtctgtgtgagggcatgggtatatgccatcactatgcaacattttaatcttcagtttttataggagtttcctctgagcactcatcaaaggtaatgggattagattttttttcttcctttgtcaaatgttttcctcaccctgaatactgtcacacacgtcgcaggtggatgagatttgtccactgaggaggaattgcacttttcgaccctcctaggatgtgacttgaatacctggcttgttccatgttgggcttgccacctgctcctgctctgaggtagccgctgacctaaaggcatcgcaagggtggtgaggtgaagagggagcaagtgttctcagccacacatttttccatctcccctcagaatccacctctcagaggtagcctaagtggccctcctaccggatgcgttgttttatcacgactgcagctttcttttcttagattctgccaatgcttttaatgggctggtcccctgcgaagagcagggattttgtgttttcttttgaagagcgtggtagatttctgagcaccctgtggcagtctgtaaaagtgataaatacaaatgatgaacaatgaagcaggctcttgagttctggggctggctacaggagaactcagaacgagggaaaaaaataaatcaatttctaacacaaaggcaagatttagcctctcattagatccaactgctacatgtaaagaagtttgttaagaaaatggcacagggattttgtgaggtggagccaagcctgcgaaataggctttcaagatgtgttttctatcttccttccaattttgggtgctatgatgtaacaggattttgaaatccaagcatatgttattttctttcttcttttccttttatgtttaaacctccattatgatgaattagctttccttcctcaataatttagagtttattttctataaaaaggaagcatttagaaatgtgatattaggcatatggccccctttcagatccttccagttctatttgtatatggttttagactcagctgtaaatatattaatttatgcagcaatggatattataaatcctacactttatatagatgtaggctctttcttttcataaacaaaacttgaaacaatactaaatttttaaaaagatagacataattgataatttcactttgagaaagcaaagtaacccagattgtaaatgttatggacaaaggctgggcgcagtggctcatgcctgtaattctagcacttcgggaggccgaggttggtagattgcctgagctcgggagtttgagaccagcctgggcaacatggtgaaaccccgtctctactaaaaatacaaaaaaaattagctgggcgtggtggtgtgtgcctgtaaagccagctatttggggggctaaggcacgagaattgcttgaacctgggagacggaggttgcagtgagccaagatcaagccactgcactccagcctgggcgacagagtgagattctgtcaaaaaaaaaaaaaaaaaaaaaaaaaaaaaaaagtcagggacaaggataaatgcaaattgtacacatttctctctcttgattttatgatagtttggaaaagaaccattttttaaaaaccagtatattactaatggatggcatctaatgtcttagtaattaaaaaaaatatagattgggatggagccacagaattcaacaatggggagaagagagaaatagaaggcagagacaattttagaataatagtcaactgtctgtggaaaaaggggagcttcagttagtgaatgaaagaattgagttttcctgatgttttcatctaagattaccctcataccacatgcacagggcttgatcataaagtatttgaagttagtaaaaatgtaactagtccagttgagctaaggaaatatcaaaatgtcaattgttctttcccaagtttagtcaagctaatcagattctttcagttgttaagaaatattctgttgtatggtttatgtgtaaatatgactagaaattctcagcagtggtaaagcatcgtaactgggcatggttgctacacatatttgtatctctgatagtgcctggcattgtcccttgcatacacaaaaagttcaaaactacatgcttaaaagtgaaggatttcactctcccctgaaagcactctatttgatagagagcagcactcttttgtgcttacagcaatgagtaaactcttagagccaggttgtgaactgcttgttgtggatatatgctgtagacatttaatcacttgataactcattagtgatatatttaattcatctaagatgatttatgtttcaaatgtgaacatgatgctttaccattacttttactatttaataaaaagataattgttgcatccatttataaattttgcattaaacatgacacatttatcttttcaaagaaaataattgttaatcttagaaaattttcctcaaatgtgcaatacaccaggcaaaaaccaaactctggttttactgtacttgaaaataaattagcatgcatttcacatggtattttgttattctcctttcatagcctgctttggttaaaaaaaaatcatgtcataaaagagatggcaaattagatctgggagtgaagaaaacttgttcctaaattttatcttagatattgaactactaaatagatgataatgaaattaatgtctatttcatgcatgaagcagctctattacgtgcttttataatttcttgcttttgagaggttaaggtggaagggcttattttctttagacactgatcctgggattcatgaacttcattattctctttatcttatgataactatgcccacagggtacaattaatgaattaattcatcaatccactcattcacatttatcgaatgcttcctgtgtgccaagcactgtgcgagtagaaaccacaagaatcaataaaatcaatagacttatatttgtctctagggggtctactgtctattgggggacaggtagaattattggaggggagggagcaacaagccctcaaacttggtgtcagcaaagtgtgaaaatcactagaaaatccacacgtaggcattggtagcatgggagctagtttaaggaggttatacttgtcttgggacttgagtgatgggaaagactttggcaactgggcaaagagaagagaggagggcagtacagaagtgggaacagaaacatgagcacataaacaggcactatatatactcatgggaagcagcaagcttcacttcggacctagggcctctcagggtactgctagaaacagattctgttgaaggtattcagcttgtgctaatagtctgtacttgttttaaagacccaggaggtctttttcagaatgtattttcttgaacagcctctttctatcaccaacatggcactgagaacaatagaaaacagctccttttgtttctgggacacacctcctcttttctaagattcatgcctggttgcccagggaaattcctcaaaccagcctttattctgagctgatcactctcttctgaacaggacattccgccatctgctcagacaccctggctgtcagccccaccctgaatcaccaggcatcacctcccttctcaaggagacctcacttctctttatgtctaaagccccacaaatggctttactccttcaaaaccctctctttctagacttcctctagcgccagcgttgcaattcctctgaccacgtatttaggcacacatataatatttagagggcctctctactccacatttaaccctgtaatatcatcttttttatattaacatcttattcctctttatcagctcatttggagccatgtttcatttcccaaaatatcaccactatattcttttggctgttgcatcaaattaccataaacccagtggcttaaaaaatctcatatttaatctcttacagttgtggaggccagaagtccaaaatagtttcactgagctgaaaccaagatagcagagctgggcgtcctctggaggctcgaggggagaatccatttccctgccttttccccttgtcccatggtccctttctccatcttcacaaccaagagcaaagcatcttcaaatctctctccgcttccacggccacatagtctccctctgcttccttcttaaaagaacacttgtgattacatttagagcccacccagataatccaagacaatctcccaccttaagatccttaatgtaatcacatctgcaaagtcatcttttccacataaggtaacatcctcagtttcctgagattagagtgtggccccatctggagcctctattccactaactacgaccacccacactaacaccattgttaatcgagtacttactctgtgccaggcattattttatgataggcaccatcattatctccattttacagatgaagcagttgaggcacagaaagctttagtaatttagtaaagtcatatagacagagaagtggtagaaagagcattcaaatctaggtctgttcaactggaaagctgtcactcattcacggaacaccctgttgcctctcacattttccagctgactgtgtgcgtctgtgttctggtttgaattaaaggaacctaaaaactctcatggtcaacacaaaatggaaaatttcccagaaactgcacatgtctcttctctagctgtacttgtagatatttcttccacaaagagcatagctaattaactggttaagtggtaacaagtagcagtttgcttccccagtgaaataccagtggaagcccccctaagtagtctgacatcaggctacggttgaagaacatgaagggccaactgagttcaggcaaagtgctatggaaacagtaatcacagagcaggtccaggaaaataatgcctgtttaaaaggacaatggaaatgaaacagaaatgtaaggcccagctactttctctgtagagaaagtgagaaaggctgaaaactcctgtagacataaggcttgaagaagaaagcttgagaataaagaatacagcacaaagggaagtactttcagtttaatttaagggaaaaatacactcagggctgactattggagatcagaaggcaaatgaacactggcaggcagtgagaaattaaggatttaaaaaatgatccttatacatttttaagaataaactttttcttttattctaaggaggcagtaaatcacgtggaaaatagaaagaactggtccctggagtcaaacagactgagggtcccattccttaatatcagcatcatacatgacaacttgagcctcagttctttcatttacaaaatgggaacaacaacacgaagattaaggaaattatatgaaccaccttagcacagtactttgcaggaatgagtagcataaaaaatcattgcatctggtttctgcaacctcagcaagacaaaaggtaatacagcttgttaaagagtccagctagctactagtgcattcagagagaattcactctgtgccaggcatggtgctggatcacgggccacaactatgaataagagaccagctatgttctttcatgaaacgatctagtggaagagtcaaacaagaaaacaggcaatcctacctaagatagaagaagcatgataaggaaatgatgggtgctatgagagcatattgggagaggatacctcacttaaacttggccagtcagagaaggcttccaggaggaaacattatcttagatgagactggaaagttgggaagaggttaagtagggaagagaggagtttggcaggggtggggggtgaggggtggagggggttgtaggcaggcagaagagacaaaggaggaagcagctcatgcaaaggtcctgggcaagagaacatggcactgctaagaaagagaaaagcagaccagtatggctgaaatgcagagtggacagagggagtgttaggaaatgagattgtgaaggaaaaaggtccccagctacatcatactctctaagtcatgtttaaaagtttggactttatcccaagggtaaagaggaaccagtgaaggatttttaagcagaagatttaatgattttatctgtattttagaaagatcatttgggctataatgtgcaggatgaactggatttaggagaaactagaggcaggaagaccactaggagatatttacaatagtctagctgagaaatgatggaggtttaactgggatcgtggcaaaaggaatggcgagaagtggacagaaataagatttggtgtttttttttttttccactcattcattcattcaactaacttttatgagtctgccttagaggagagacacgagggtgagatagagagaggtatcaagattggccccatgtttcagcgttaaaaaaaagcatagatagtggtgccatttacaggggtaggaaacatggggtagcaggctcttgggaagatactgagtgcagtttttgacatgataggtttttgtgtcatgcctttatttttgtaacctcgatatctttgtgtaccccaacctgtgagaatagatgaggtcatattaacagtaataaccaagtccagtgatactttagttctctctcatctttgttcctcgcccagttaattctgattgtccacaaggatgagcttcacgtgtatttgggaacaaatctgtttgctgccttctgtcaggcctttttgcaatggtgccaagaacttcttatgactgtgggccatctgtactgatgctgctgcctcagtcaccactgtcctcagctggtacctgctctgtggcctttgatgtgtgtgtgtatatagggaaggtgggggtgcttctttctctagatattctctattaattaactaacacagagctaatatgtgagtttgtaaataacacatgccttgcatttggcattgctaaaaataccttcaagggctaacaactttgcatcttatctcccagcatgcatgggttgaccactacagacaaaagatcatgaagctgatgctggccaaagagccttgcacattttcaccctcaagttggttttatgtagcaattgcggataaaaagctctgctggtataaaaatcttcttattgtacaaatggcaggaaatagaagacaacattgcggtggttacaaaaatttgtttcctagtttgtttctgccagctttaaattgaacatagatcaatctataggttctgaattagtaatattggggagacatgaaatgagaaaaatagcagaattaaataagcataacagtgcacggggcagcccagcatgctctggagcgatgaggggtgagagagaaaggaagaaaagaagaaaacaaaatgaacacctttcaaatccaaaacaatgcaccacgtttgagcctccaatatagttttacaaagacagaatagccatgaaatcaaacatttaagtataaataggtaacatatgtctgtcttattgttgttaaaaattaactgtgatagactgaaattccattccacattcctacttcttgatgacttagtaaattacaggcatttcaagagaaatgcctaaaaattttaggtgaaccatcgacgatattttgggtggaagtaagttatatgtggtagctaaatacttgtgctcaagctctcagcatcctgtttatacttctaggaaagacatatgaaatgtgaacaatttcaaggaatgaaataaatgttcttctttatctataaaagtctgattgtggtgtttaaaggcttccatgaaacaaaaacacctgtgcccacagctcgtctcccgtgcataaaaacagaatacaaagatgagacagtaggaataggaggaacattttctatttctccaatatttcccacatgctttggctgtttttgaatagaccttctgaaatatcttttgaggtcacctactttgtgaacctaaagtctctgatttttcaggtgacatggcagcaagcccgaatgtctgaaaacataaatcttagttataatttccatttttgtcattttgctagaaaagaaaaatatgataatttcttccccagcttgctaagcctttgctagtttcaggaatttctgctaccatctgatgaaaatcaaaatccccgtattaaacaccaaaaagctatatcacaaaaaagtgaagccatcctagtaagtgcctcatcacttcttgtttttgagatagagtaaccaaggtagcaatagaagtctcagagagagctgatggtttctaattccataaacttagtggacaagtacattttccacatgaaccaaaatcattgccgccatggtgaatcaaaaaagtaataacaaaaattcacattaccagcacgctgttattttaaaaatccaattttacaaaataaaactcacctaaactgaagctgtggaataattttagcaattgaaaattactaccttctctagaataacatgtacttagaaatgaaatgattcagaaatcaacatgatgtacgtattctgcttttctttgcagcttagagcaaattcaacatcaatttacactatatcatagtaaatatattcaacaatcagtgcttaagtaatttagcctgtctttgctgcatctaaatattctgctgtttaactaaattcactccatactatagatgataaaaatattaatatacacatttcattcttattaaaaagctggatttctcccttagccctgcaagtaccataagcaaccaaatcagaggaaaagggtatgttggggctactctttataaaattgttcatccccagttcacagacatcatgaaacatgaaattaactccagtatgttaaaagaaagatgatagattagcacagaaatcaagcacaaagaaacgatttattttcctttccatagcccagaattgctattagcttaccttattagctggaatgccaaacagaatgtctttatggaaaattaagttcattattcatctcagctttgatttggtatagtgcagctgagagcatttagcttctctctatgatttgccgattctaagtggttgagtgaggcagtaaacacaggacttgggggtggggggagagtggttggtcatggctcacaactcaagatttgcaactttacattttcattcatataaagatacttaatgaaataaaaccctatagctgaagaataacacttaagtgaatacttagtgcagatttttcagcctgtgcaattttgcatagcagttgtacttacagagtctggcatgctcactgtcccagcaaaatcatattgctatctttcattatctcagtaaattctgggctattgatcactttgcagcccatatagggggtaacgtatattctgtcaaatggaagtccccatcagggaacgatccttgcagcttgctaaaagaagcatgcctgattgtctgactagtgatggaaagacagatgccttttacaatgttgaagtgtgcacatgcacaaattggatagaacattcagtcagctaacaaacagagagattttaaggagtaaaataacaatagatttccatccttgagatatcaaattctcttttagagaaaaattaagtaatacttctcaacaattcattcattttcttcaaaagaattaaacgtgttgtagaaacctcttggcaaacacttttcattttttaaaaaattgacttccatagagaaacatcccagaaaatcttattgaaagtgtggtgtgtgtgtgtgtgtgtgtgtgtgtgtgtgtgtgtgtctcatttcgggatggggcaaaggaactgttgcagcgtcctcttccaagtatttcactttataagttttaagtgggcagcatttactaaaatccagctttactgagtgcaatctgcaaccacatcagcaagatcacttttaggttatcaatagacaaggacaatacaatttcagtagagcaaagacttacacctttcctttcttcgtcaccatacaaaaccaaaccctaaaactttcctctactgaattaataaaagcacaggtgcatttaataagaaatgataaggaaaattataattaaatgattggtttgtttcaaagtgttaagtatagtgtcaccatatgacccagcaatcacgcttttaggcatataccaggagaaatgaaagcaaatgtccacacaaacacttgtacacaaatgttcacagcaccattattcacaatagtcaaaaagtggaaacaacccttgtatccactaactgatgaaaggattaaaagtgtagtatatccatacaataaaacattatttggaatgaaaagaaatgaaatattgatacctgctataacatggataaatcttaaaaatagtatgataattgaaagaggccagtctcaaaagatcacatattacaatattctatttatatgaaatgtccagaaaaggcagaatctatagggacagaaaagtagactagtggttgccctggacctggggtagggggaccaggaagtgattgctaacaggtacaggattccttattggagtgaagaaaatatttttatcttagatcttggtgatggttgcacaattgtgaacacattaaacccattaaattgtctactttaaatgggtaaataatatcacaataaaatttattttaacatgatgcattacattgatttgtgaatgttaaattaactttacatccctaagataacatttgcttgctcatgatatatgatcttttaaatatattgatgtattcaatttgttaaagggcttgcatgtctattttataaggaagctaggtcagtaaatttcttttcttgtaatatctttttcttgttttggtatcaggatagcattggcctaagaaaataaatcctgtttctgaaaaaaagagatgttataaaattattaatttgccaaaagaacgttgtcatatgtttataattatatgaatgagttttatataacacattctacacaaggcagatagggagaggttggggaagagaaaggatgaccccaaatgtgggatgctcttgaagactagaaggctgcagacgtatctcaagaaccacctgtgccggtgttttatcatggctaattttcagcaagaaaacaaatctccaaatctgcaagagtaagagcaccaggaaaaagaggaggactaggaagaagaggaagaagagaataaagatgaaggggaggaataaaagaaggaggaagaggaagacagaggagaataagatgagggggagagctgtgtttgatcaagagcatgaaagggcaggcaattcaggggaaggtaggatcaccaaacgtaattatagcaacatcctaccaaatgatccagacgagaataaaggaagcctagaaagaaaccaaaagaattgcacaatgagggttttgaagtattccaatgaaagaaacctgttttaaacatgagagatgggttcacaatcaagaaagaacacaggtaagtgataagtgcctacacaaagtgccccaaaagggctaaagcccagaatgaaatgaggtttgtgaattttaaaaagagacaagggccaggcacggtgtctcacttctgtaatcccaacattttgggaagctgagatgtttgagacctccctgggcaacagagtgggaccctgtctctacagaaaataaaaaaattaaccaggtaaaattagcatgcaagtagtcccagctgattaggaagctgaggtgggaggatcctttgagctcaggtgtttgaagctgcagtgagtcatgatcgtgccattgcactccagcctggatgatggagcaaggccccgtctcaaaaaaaaaaaaaaaaaaaaaaaaaaaaaaagccaaggacagtaaacacaaaaaagactttttaaaagagatggcttagaatgaatagaatgaggaaaatcccaaggcttgttccagatggtacaatgtgaacagatgataatgaaagaggaggaagaggaggaggagcagtagggaggagggaggagaaggacaaatatcaaactctcacacttttatttttctactattttctctatcagaggacatgatcttcaaattttaaaagggagaagacgcatggtaaagagaaatttgaactccagcaaaacctcttctatgcagatgactcatgcatttatatttttgttccagaactcccatgtgagagtcaggtacctgccaacttcacttagatacttcaaagtgctgcatacatagcaccttcaaaaccaaactctcccgcccccatctccaccccagcagtaaaagtactgggctcctgtagagttctgtacttcagtgaatggaacaactgtcttctacgcaggtcagaaacctgggtactctttttggacacttccctctcctgccatatcaccaagagatattgatttggaatctccggaaaccacccacttaccccaatatcactgtcaccatcctagtcccagtaaccattttcttgcacctggatattacatttgtcttctaaccgattctcctcttccactgtccttctccttccactccatccaaaaggatgttttcagagggcaaagtagatattagctttctttgctcctccccccaacactagcaaggatataaagattcaaatgttaaacgtgacctctggggccctgtgacatggtcctgcatctttccagacttatctagcactatcttggtgatccagccgtgctggattcatttctcacccttttgtttctttctgcctttgcaaacgctcttccctctactggaggcatgattcccttggctcattgtctgattaagtctagattttcttcagacctcatcccagtcttacttcatagggcatgctttgctgaacatctcaagtcaatatgcgattatctaatctcttctgtaggtattgagccaagtgatcatttgggatcaactttacttatgagcagaaggctcaaaaggtgcatgggtcactacactcttagtatcttcaaagagactcacctaaggttgagtctctttgttaaattcactgtggagagaactgactctctgctagccacccttctaataggatgagtatgaggggtgcattgcatggagggaggcaggaaataaacactttgagatcaaggacactacagaagatctcaggtactagatgcataggggagtgctaagaaataccaattccgcatgccctagactccatagggccctagtccagtggaaagttgaattctgctatcatttctcccaatgaagaaagggacagccctgattgcagacatttcactgccagagaaccagggcagagctcccagaatagttcaacagcagcccttaccatggtagtaaactgacattcatttgtgtgattgatttgagaatgtttatctcaccactgaacaatgggagcgcaagagcagcaatcatatatgtttctgatcatcttgttatcctttgcctctactcggggcctagtgatagtaggcatttaataaatatttttgaatgaatgaatgacagagctcttaaattgctaggctgtgctgagagggtaatgacagcattaactgcgattagcaaaacacttgaaaccaagtgttttatatagagtgttagtactagtggtcttgtttataaatctgacctttctatatctttctctggccaataacactgtgatgccattaaggcatgaagattcaatattagtcaaacacatacattctgcttagaaaattagcatgtgggatgttgaggccaggtgcagtggctcacgtctgtaatcccagcactttgggaggctgaggtgggcggatcacttcaagtcaggagttcaagagcagcctggccaacgtggtgaaactaacaagacaaaaattaaaatacaaaaatctctactaaaaatacaaaaattagccaggcattgtggtggctgcttgtaatcccagctactcgggaggctgaggcaggagaatcacttgaacctagtgaggcagaggttgcagtgagctgagattgtgtcactgcactctagtctgggtgacagagcaagactccatctcaaaaaaaaaattagcatgtgggatgtcgatttaaaatattataagatccattagatgaatgatttaattttcccaatgaagacatttttctttttaaaaagaggacacacctaaaaatattaagctcgaatttttgtgcttgacaaattataacacaaagaacttttggtagggcccccaaaatcaacctgggcattcttaaagattgttaaaagaaacggtggtggcaaaacactgaagatagacaagacttttgaagctttaaagaaatatgttctgtatatagtagcatgataggcttgactttatacctcagcatcatcctagaacaggctgttaaatggaaggtccgtgagtgcttaaagaagcaacccacatttacaaagaagtagtatgctaagctgactgtgctttatttttattttttatttttgaagattaacttggttgataggtaaacacacacactgagatttcttataaaaaatcatctttatagaaaaaaaacaggagaaaaagatttctaaatggtaacaggactggttttcacaggagctgaattttctcacttctcctggaatctattccaaacaacaaaacaacaatacaacaaaatgaaaagaaacacccacaaattacattttcagcaaaaccagcagaaaatccacagactccaaagtcagagtcaggcagaaagccaaggagaaaagtcttaatactgtggtaggtaagtgggaggtatgaaggggttctagatatagcagaactcagaaatctctgttgaatatccactccccaaaagtaagggccttaatccaagaggaaagtgctgcagaaaagactgaaatttacgcagcaggtggagggtaaatggcaaatctcattagggccaggaaaattctaaaagtgttactgaaagtgacggcatcatttgtgttcccatgtgacaggcagcctgtgaagtgatccatgaagtaattgaggaagaacagaactaggtttggttctgagtcagatgatgtgtgactatatagatggatcatattatgaagaaacaattgtagcagcagcaaaggaagcctttgatgcttggaaaactactgcccatcattccctctacaggaacattcttttgatttcctaggaaaattcaactcattcaaataggagtaatatacaagtaatacacatacagatatgataagaaatatggcctatgacatgaatttacctatataacaaacctgcacaatatcctgaacctaaaataaaagtttaaaagtaaaaaaataaaagaaacatgaagaagaccagtcaggaatttcttgtaaataatgaaaactcaactgaaatatatgttgtcacaaaaaagattaaaagcataacccaacattgttattaattaaaccaataattaatgaagcagttatagctataaaagaagatcacaaagcagagttgtaagaactcagggaagaaatgagaagaaaacaggaggttactggtacactgctggaggatgtcaaatgggaactggcggaattgaaggaaaggaaggtaaaggaagggacataaaagataaaaagtgaaaatgcaagtaaattatacagaggcaaaaaagataaagaaggattagagagaaaaggacatgtatcgaatatggcaaaggagagccatcatatgcatagctgtgatctcagaagaagaaagccaaaacaatggaatagaataattactttaaaatataattcaataaaacttttctaaaataaaaaagccttaaatctacttatgaaaaagatatccattgtatcagtgcaaagtcgtctagaatgatcaacccaaagacacatcccagaaaaatttttgaaaagaatccttaaggcagtcaaggaaaaagataaaaatcagttaaggaagagaaaatgaagttgacatcagatttatccacagaaatatctaacctcagcaaagagtggagcaggatccataagataccaagttagaaggcaggagtcaaagattttctctctaataacgctccccttcagtatcaagactcaaggaaaaaggcagctttgagcctgccaggatttgggtaacactgtttcctcatgttttctaggggaagatcctaaaggaggtgctatagactaacatgaatcaacagagaaatgtcggcaaaagaacctgtggccagtgtttaaatgatccaacatgacaggaagttcctgttggctacatatatataccctttaagaatttttttctattcccaatttgttataataatttttttgttagatcattaatggctgttgaatatttggaaataccttttctgcatatattgagacaatcctatgtgctttttatcctttaatctttaagcactgagagttatgtgaatatcttttccaaagttaacctttctttttgttaataaataattgtcatctggccatgttattttacattatttttaattatttaattgtatttttaagtttattaagaatttttatgtcagattcatgaaagaaattgcatttaaatttttctttcttaaatggcccttgtctggtttaagtctatattaaatcctgaaactagttgggcatttattttttgttgttgttgttgttctaatttctagaagaatttttatacgacagggattacctcttcttgcaggttttataaaaattaatagggtctggtctttttctgagtaaattttaaactaaaattttaaattttaatatgtcagtttcttaagttgttatggatatattcaaggtttctgtttttactgagttttgaatgctttatttttccaggaaactgaacacttacattttcaaggtacaggttgagtattccttatctgaaatgcttggaaccagaaaggttttgaatttcagattttttcggattttagaacacggtcatgggccaaacgacattttggtcaataatgattggatgtaagacagtagccccataagattataataccatatttgtatcttttctatgtttaggcacacaaatacttatcattgtgttataattgcctacagtattcagcacagtaacaggcggtaagattctgtgatctaggagcaataggctatatcatagctgaggggtgtaggaggctctactatctaggatgtgtcagtaaactctatgatgttcacacaacaaccaagttaccttacagtgcgtttctctgaaggtattcccgtcattaagtgatgcctggttgtgtttccatcttactggttcagcaaccccaatccaaaaatctgaaattcaaaatgctccaatgagcatttcctttgagtgtcatgttggctctcaaaatgttttggattttggagcatttaggatttgagattttcaaattaggcacactcaacctgcactcgtatgaagtttgtttctgtttttgctcatatgatagatttaatatctactgcatatatatccacggcccttttttcatttctgttagtgtttatattgtgctttctttttttccctccttggtgactttactcagaggtttattaatattatcagtctttccaaagaacaacaacaacacaaacttgctaacagtgattatgtctgggggatttctattatcttctttatgttcttaggtattttacaaaatgtacccaataaatgcatattaagtttatgaacccctccccctaataacacctgtaacaaagtaatatgcttttaaataaaattttaaaatgtagactggataggagattcataactggttgaatgacttttcctaaatggtatctaaataatttcatgaaaaagaacaggacagtctctagcgagaagcagagtctttctttctagccctattctgaacttttaaaaattgccaacttcaacaatgagatattggatacaattatgagtattaaaatatcatacatacattggtgggggaaatatttaaaatattggatctcagatttagcattccccaattttgttattgttttgaaaacattctttttggtaattcaaatgacacttttagatgagcgatttagaaacaagttgttctttcctcaagattctactgccattttctggaaaattatagtaataaacgaataactgtaagatgactactaacgtaagtggagctccctagagttaggtagtgcacaagctgcacatcagtaaccagtggcccttgcctagaatacactcatatctatataataatatttaatacagatacatgtaattgtaatactctacattgtgttaaaccacctgagtgtgcagtacagtgtggggaaacctatcagtatgatttcgtgtgaaaaaatggtcctagaaattttacctgagtgtgaggcagcctgacatgattaccagacaagctggtactttgatagaagttcatggccaaagagttccactgaatgctgtgaagtctggacccaaatgaaataataatattcacgctatgacaccataagctaagagggatgcttttcttgggatgagatacaatttgtcagatgagatgctcaaagtcctgttcttaaagaattgctgaaggcaatattcacaatagcaaagtcatggaatcaacctaaatgcccatgaacgacagactggataaagaaaatgcagtacatatacaccacggaatactacgcagccataaaaaagaatgaacttatatcctttgcagcaacatggatggaactagaggccattattctaagtgaactaacacaggaacagaaagccaaatactgcatattctcacttaagccaaacattaagtacatatggacacaaacaagggaacaacagactctggggcctacttgagggtggagggagggaggaaggtgaagatcaaaaagctgcctatcgggtgttacgcttattacctgagtgacaaaataatctgtacaccaaatccccttggcaggcaatttgcctatgtaataaacctgcacatgtaccccttacctaaaataaaagtaaaaaaaaagctgaaggaattagttctatcgatggtggaaaaatgaagacttaagtggcaaataatggtttgcattaaacatttgaaggaatgccatgtggaggagtaattaggtatatttcctgttgttttacaatcaacaaaagggaggtagattttaaaaaattaattaattaattaatttatttattttgagacggagtctcactctgtcatccaggctggagtgtaatggcatggtctcggctcactgcaacctccacctccccggtacaagcaattctcccacctcagcctgccaagtagctgggactacagacgcgtgccaccacaccaggctaatttttgtatttttagtagagacggggttcactatgttggccaggctggtctggaactcctgacctcgtgatccgcctgcctcggcctctcaaagtgctgggattacaggcgtgagccaccacgcctggccaaaaaatttattcttattttatggctccaagacaaattcaaagagaagtggatttggattcacaatacagaagaatcgtctacaaagcatgtcaagaatggaaagtgccattggggtgggaatccaggccacttttctagagatcactggtaatatgtgcaaggagtcaatctatgtgtaatatttagtgttttgcatgactgttggcctggctcatctacttccaggaatttttcctgaataaacaactagatgattattgaagagtttgtaacagtaagggatttgaataggttactaagtaaatacaaagaaaagaaaaagaaatgtgaaagaaacattaacgagagcaaagagagctgggaaagagaatgaactcaacggaacagaaactacaattataagcactggggtaaaaaagagtgtgagacattattagaaaatggccagtcaaaataaggttgaatgcaagacactgaggcaatggcccaatttttttgttaattagatgagagaattgtgattgctaaaattaaacttagattgaggaactctggtgaagtgaggtcaacagaaatagctaataggtgggaaattaccttagtcacttgaaacagaagaaacctattactaatgggtattaaattatttataatataaagaaatacaggccagacgcggtggctcatgcctgtaatcccagcactttgggaggccgaagcgggcagatcacgaggtcaggagatcgagaccatcctggctaacacagtgaaaccccgtctctactaaaaatacaaaaaattagccgggtgtggtggcaggcagctgtagtcccagctactcgggaggctgaggcaggataatggcgtgaacctgggaggcagatcttgcagtgagccgagattccgccaccgcactccagcctgggcgacagagcaagactccgtccccctccaaaaaaaaaaagaaacacagctgattatttagtgtcatgctacatccatagaggacttcagtatatagtatgaagaaagtgcttgctctatgtattaaattatttataatataaagaaatacagctgattatttagtataatgctacatccatagaggacttcagtatgtagtatgaagaagatgcttgctctgtaagtgtgcactctaggctagatattgacccagacatttgtgatgtctccatctgaaaataacaaaaagagccgaaaacctctgtagattattatttaaaattagaatatttaaattattttaagatgctaagaattacttgcattactttcttcaaattgaaggatgtgcataatatttgggaattctaaccaggaaaagagttttagcctttcattgaaaatgacatttatggtattattcaaaatggtaaaaagctgtttaaaaattcaaatgacaatgaatagaaatagaaatgaatattctagccatggtgtatttacatactataataacaatacatattttcattaaatgatagagtattattgaaaataataaacatttatcaaaatgacacaaaatgatttttaccctaccagtttaaggaaactcttggcatgtgcagtagttacttcccaattgccaagttcacgatcaagctttccattccttgtctgactggaccactccttggtagttgactttgttaaactttccctgtttcttgaaatcctcttcgtctccctttactcccacacttttctggcctatttttatgacctttcttagtgcttttcctatgattcctgctgtgtagcccaggaagttggcttgtgatgtctcatcttctgactttacacatgccccagtgtgacctcattcactctcaaactcctctcagcctcctatgtgataactccccagtgcctttctccagttctgatgtcttccagaactgcacaatcataaatccagctgccttcattcctccctcttcctcatccaccccactcaattcttgaccaacttgatactctcaagatacagtagaaaggtgtgtttacttctctccatctttattgcttcaatcctattccaaacacaatcatttcttatctggtttactataataacttcccaaatagtatctgaataaatgaacatttgcctacgggatatcttcaactgaataggcttcaggcatataagattcagcaggccgagaacaaaaccaacttctccatctaaatgtattctttctcctacattaattatctcagttggaagtattgacaggcacccaatttttcaaactataaatttttcatcatttttacttttctctttccagacacctcagtagttcaatcactaagtccaggtgattctatacttaaaacatgttttttcctatttaaaaaactttaaccatcagttcccctctcctcccaggttggtgagagctctttgagggcaagagtcatgtcctttcaactttgtattcccagcctttaacagagcccttaatctgaaatatacttagtgctcacaagtgtctgaattaaaaattatatcatatacaacaaaagggaaacatatatatatatacgtgtatatatacatatatatacacgtatatatatatgcacacacacacacacacatatatatatataaaacacctgattgcaaatgtgcaagatgtatgcatttacatgtatagatactggaaggggatttcaaatgacatgaataattggtgttttactataaagttaagagactgataaaaatttcaaataagaagcagcaaatatgttactcataggcaaaggggaatctagatctaataaactaaaaaattgtctggcatgagattcttctgctctaaaaagcttactaaatgagctttcacatgataaacattagagggcataccatctcacaagaaaggaacactccttttagatgacactaagagttaacactttaaatgtaagaagaaaagtggtggatgaagctattgaatgcttatgtttcaagaagagtgaacaatagaactttcatgcttcagagctttttccatacatgaggttataagtatattttaagtgagatgttagagcaggtgacaatttttaacagggactaaaaaattaattgcaactcaaaaattaacaatatttaagagtgaatgactgtatactgcagagtatgtaagtaagtacaccatctacaagtgctctgatttcaaatagtgatttgaatggacatgctgcctaactattttagaagagtattcttttaaaataatctaaaaaacacagaaatggatggtattttcatttcatcaccatatacgtgaaatatccagggaccagtgcatatatacaatgatctcatttagctgataggcaatagatatataatttcacacatctttcacaccaagtttaaaaaaatggtattaagtttaagaaatagcttatgttttagatagtagattctgtagtaggcagattacggactccccaaagacgcccatgtcttaatccatggaacctgtgaatgttaccttatatagcagaagggacttcacagatgtgagtaatttactggtcttgagatggggagattgtcgtgcattatcaagtgggcccaatataatcacaaataagtagaaggaaagtcagagcgagagttgtggccacagacacagatcagggtgatgcaattgctggctttggagatgaaggaagaggccaggagtcaaggaatgtaggtggcttctagaagcttgaaaaggcaagaaaagggtgtcttctctagaaacctccagaaggaacatagccctactgatgttttgattgtagctcattgagacccattgtggacttgtaacctgcagaactgtacgataataaatttgcgttgtgggccaggcacggtggctcacgcctgtaatcccagcactttgggaggccgaggtgggcagatcatgaggtcaggagatcgagaccatcctggctaacatggtgaaacccgtctctactaaaaatgcaaaaaattagccaggcgtggtggtgggcatctgtagtcccagctactcgggaggctgaggcaggagaatggcgtgaacctgggaggtggagcttgcagtgagccgagattgcgccactgcactccagcctgggcgacagagcgagactctgtctcaaaaaataaataaataaataaatttgcattgtattaaggcactaaattgggggcattttgttattgcagccataggaagttaatacagatgctgaagggtttcatgtgctcaaaaccctgataagtgaaactgtaatctctaacagtaacttttgcaatgtctcttaaatctgctctcttgcttcagttcacactgctaacactgtgttttttcaggcataataataataggatttattgaggcatcatataatgtcccatttccaagcattggtctgcaccttccacatgtattaacacaattaattcttttgacaaccctgtatgataggtatttttattatctccacattacagaggaggagaccatggcagatagacatgaaatatctcactcaatgttgtataactgctaaaacacaggatttgaacacagctttctggtagcaaagctatatttactcttcccagaatgaacttcatggcccttgaactgcatggctgtcaatgaaggtgaacgcctcactaatttaccatctatgttgactgttgaattattgtggcagacagaattttggctcccatgatctccacctcctggtgtcatgcccttgaatttgtgacgtttcatggaaaaagggactttgcagatggaattaagtgattttcaggtacttgtcaggcatgggggatatagggctgaactattgagagattaacaaataatgagaaaatgctaagagaaatctctcccgttatactcccatagaaatactttcaaggcttcagagatatgatatttcaaatgaggaaacgtccttatcctccatccttccttacttacaatccaggtttaaattctttctgtaaacttccctattctttgttcagatacctttatgcttctccctttgcccatgtatttagttatttaatgttccactggactataaactttttcagagtaggaactgttttagaagtctttgaattcccatttcctatcaacttcgacgcttatatagagaagatcttcattgtttgttacttgaatcgattattcaggaaaaactcctttacaaaaaatcctatgacagggattacattgttataggagctccaaattccaatagaggatctgttcacttcagctaatattcatccacaataataattctttaaaaactttatattcctcaaattattctacaggctttcctaataaactgtcatcataaggaagaaggaaagccatcaattttatgcttttaaggaaaaagcatataattttttaaatgtcataatttaaacttgttagtgaccccttatttcttctgggcacatgataaaggctaagaacttttcttctaagcaagatgaacatctcacccactcccctgacttttatataatttcaggagtttgctgattgtgtagagtccaatcttgcacatcctacagggcacacagcctcagatagagaacacctgaattaggtggatgagatgccctgcccttctgcgcttgactttctgcccagtgcccccaccctgccctctaccccatccaaaggtctttttgagataggattatttcagaagtcagtcaaatgtgcaatctcagcagttctgcttctgtgctgccccagcctgactagtgacaaccctgctgatgttccaatcctaaacattatcttcctctgacagtccacattagggaatcctgcctcaataagcttttccaatgggcctgccaccaatggcattgttctgatttgttgggctgaagtgatctctctctttccaggcctcaaagatggcgaaagagtgcctggtttcagagagcaatacgaaaaatgcagctttggaagtctggtgagtaaacaaatgaagccagacgttgacacttgtacatcaatcatgttcatttttcaatgtgcattggaaaggtttgagactcacttgtctcagcaaacagggttcaattaaaccagtaccctggataggccataatggacactccaagggcctttctggaaagccctttccctttggccaaaggcataagcaatgtggggtagacaggagtcttttgggtaacacgtaaactgaacctgtcagaggatgaggggccctgtctgaacggcaccagccaagggactggctgtagcagatatgatgatgcattgccaactgccatatccatctgcacccagatattgctcctagaggtgtcaaaacattgtaatttacaagtaaatgtgaggagaagaaaagttttgcagacatgtttcttaaatgaggaagagaatcacagatgaggattactgtccaaaagagagcttcagcaactaccgcccaaaactcagcgtgagaatggagatatcacgtaaggtgctgcctacttggctgatggtgagggaggtacaaaacgcagaggagccgacaggcacgtggaggggacagcgccaggtgggtgggaagatccagggagataatgcacatgacgtgcccagcacaatggccagcaggtcatgagtgactaataaaaggtggctaagaatcccaccaaaaccccaggcccatgttagtcctcatgtttctaaggggaagtgagttgtacttattgaaagctaggtatgttacataattgactcctcaaaacaactctacgaggtaagtatttttgcaaatgaagaaaaagaagttttaatggtggaatgatttatttaatgccacactgtgagggcatggaggacaggcattcaagcagggcggccctcgccctcactgggcctccctgccccgctttgggcacacagaaaactaccaggcaatttggacacctctaatcactgggacatcaccacagggtattacctttttatggcaaagccccaatctactagaagtcaagagagtaaaaaacaattagagcaatgctgtccaatacaactttctgtgatgacggaaatgttgattgagggattaataaacaacaggaaacatggttactgaccactagaaacgtagctacggtgactgagaaactggatttttatttttttcaaactttaattcattgaaatttacagatccacatgtggctagtggctaccacgtgggacagcagagaactagactacctgatttaaaaggaaccctagggctcatttgccctcatttcaccaaatagggaaatgtcctttgctttatgcctcatgtgttcatccagtttctcatagcacatttttaataacaagaaactcttccttttacttgggatctgatgcctttgttagaaaaatcatcccaatctaatagctacatcctcaggtgttataatctggagataaagttaagttttggtaataaacccgttcattattccctggggttatctcctaactagctagctctgctcttctcacacctggaagcatttaggtctctgagggtggccccagaggcatctaaattctctgggtgcacagtgttgctactgctatccacagcgtccatgccattccatcttgctgactggtactgatgctgagtgcatggatgcgatgtgaatctgagggtattttcctcacaacagtgcagtgctgcttgctaggtttcttccccagggcccgctcagccccaccacctctgcagccagctgcctggtggctgggctcgggagcctgcaacctcccaggcccctctaggaagcagctccctgctcttttcctatcctcataccattggttcccctgagaaatgctgcccagaggttaaattcctttggcctggcctccaggctagaccatatcttccatctttgggcaacttgggtaccttagaaaataaaatcctgtattatcttgtcaactaggaataaattctgttctccacttgcttatttctaccagctgagtggtcagctacccatctggtcttttccctcctgcttttatctggccactgcccccagagttcagtctgggtcaaacaagtgctaaagaaatcttggttgaataaaagactcagggagaatgacagtattataaaatcatttaacagaatttttcattatatgcttgtggacagaaaatgtgaggggaatacatgttacaacaggtagaatcaagatgggttgaagcgaagaaatgcaacgcttagttctattcatctattcatctaataacaccttcaaaaacatacaagagatcaaattggcatggtttaattttagggaattatttcacttctcagttccttagaagtccctgttaagtgaataattaatatttcattcttatgcatggtgatatgttataaaacattgaaccaaaaggaagtggaggcttttaaacatgccatattaggactaacccttattttaaattaacttcatctgggcttaaacaaagaggggagagaattaagcaagagtttgctatagaacactgaactatctgcagtgtgatacatgtacatgaggaaatacccaaaaccagctaagaagaaggattatgaagactacattgactttgacttctaagttcatcactgagaatggcacctttattctgatagacttccgaagtcttactattctgcattgttgtctgttataaggatttaatataaactctactgatattctctaacagcaccgtttatgcactggatacctgcagccacctctaaggtggcacatgtaactgttccaccttggatagtatatgactcactaattcaattttactttgatgggtaattacgcaacattctaagggtagatctttagagaaacatatcttttccttcaaacctggactagtaatttaacaaatagtaaaatgggtaaatctcccaaacacttagttaacactctgggatatatgaggctcatgtaccaagcagaattctggttcacagtaggctgagagataaccatctggtctcccaaaaagtaaggacagacaaaatataaaatcacactgacttatctctgtaagtctggattttgggtttgggtttaatttaattgggtttgaagactcctagtttacttcctaatcatttcagaagcagacattccaaaattaaattaagcaaagaatattaaatgggcagacagtgcatatttgtccgtaagaaccttacagtgttattaacaatgttataactacaattaggctggcagtctcatggggtcagtagtattgtttcttgttgaaacagacaagcaaataaacacaaggagccttgagtaaaggttctttcataggttgagatatacatttccactgacatgaaataatgtcctattacaacctttttatatatctcactttgcaaatcaacctcatatattacttgttttcaaacatgactactttccaaactagatttagttttacacctaatcatagaagtagaacctgttttttaaaccataattattcatttttaattgttattaaaagaaattctcatttaaaaatccttcaagagaagaccaaaggaaatatttgcaaagcagaggcatcatgttatggtggaaagcaaacagattgtggaatcagacaggccagagtttaaatctcagttttgtcacttactaggagaataatcttgagcaaatttaataccctccttttcatataaaacaggggtcagaacggctaccccagaaacttccagaaataaagacaatgtaagaagaacaatgtatggtaaacacaagtccatagaaccttcttagtaagttaaagttcttcttactctccttcttgttccctttaccccatcttcatcttattcttagtcatggtcacataaaagtggatccagcatgggatggagatgaaaagatgttcagtatggtgctgtggaaagagcactagcctgggagtcaaggggcctgtgtgttcctaaaaaagtcaattcctctttttttgggtcacagctggagaaaaggtatgaaggtaacataagaatttgtctatcagagcttaaagcccaaaagtgattttgtagtctgagtcaatcaggaactcctggagtcccaggatcaattgctgtctttttaatgaagggcagggcaccagggctgcagtctggactgctgctgctgctgctaatacaacttaccacactggggacggataactttccaagctcagaatacagatcccaattttttggggggaacttatcagagttttccgattgatctcatttattaagagtgggcttattaagaacagatacagaagtttccctcctggatcattaaactctttcttagacagcttagattgattaatagggaaggaatgggcagtagttttcaaattatagacagcccaggtacagggtggggtggggtggcttggggagagaatttagatttgaaacctcctgttcttgcgtccatgtgagtagtgctgttttaaattgttttacatgttttgctttatttgaacacagactttggtggttaaaaagtacaaaatgcactgggctaagtgatactttgagttgttccagacacctgcttctattgatggtgtgtgttcttggaaaattaataaagaaaggcataatgagatgctctttctagaaactttagcaatagacagggcgtaggccacagcaaattagatccagccaccagagtggaaagggcaggggctgggactggaaggaaatgtcttgaatatccatcaagtgtggaattagtgttattttttattttatttatatatattttttgagacaaagtcttgctgtgtcacccaggatggagtgcagtggtgctaccttggatcactgtaacctctgcttcgcgggttcaagcaattctcctgcctcagcttcccaaggacctgggaactacaggcacatgccaccacacccggctaatttttttgtatctttagtagagacggggtttcactatgttggccatgctggtcttgaactcctgacctcgtgatccgcccgccttggcctcccaaagtgctgggattacaggtgtgaaccactgcgcccagccagaatcagtgttattaacactgtgagtcacagtgtgggtaacatcaagataacttgaaaataagaggagctcaggaagacttttgagtgccactgcttttccccgcctctctccacaactgagggccatggaaatgccacttagcctctccagatctcagttgtctcattgtaaactgacaatcttggactaggattcccttccaaattatgtaataaaatagctgcacaaaaggaaagggaaaagaagtgagagaagggagtactggggaggggaaagtattgctgagctcagctctcttgctaaagagggttcacggggtggggaaggaaggaggaggggatgaaattaaccactggtatgggtttctaaggcttgtgtcagtaagatcagtgaacgaagaaattaaggtcctgcctagcatgggcacagtgttccaggagtgtcatgccccactctgggggctctgtgatgtggaccatgggtggggcctcgtaggcaaaagagaagggctgttgggaggagaaatggggatggggaaaatcatttcaaatttcccatgatggaaaggctacaggaattggttatctagatttacaaatagaatctaataaataaaacttgtttttttttattttttgtttttatagcagtgtgaaagtcaaagtacatgtttttaaagaagcatgaaagttcagatgagacacacttgatggcttgttcagttcatgagatcttctggcatgaaataaaatgtttctttttccatgcagtgattgcgtaactcaaatatggcaaagctacctacacgataattttcggcctgtggatttgatttttcataagcctcaccacacacccctcacagaaagctcttgtttctagtggattcgtttcacctcctttgtgaaagccttagagagaaggcagtaagcagggaaaatcagctatttataggcgtttttgactaaaagtgtctgctcagcgtgccatggaatacttccaagaggtgggagaacaggaaacgatctaaaatcgactagaaggctggaggagtgttatgggggaatgattttgcaggggagtcattttcagaaagctcaggtttcatttgcaaacaaatgaactgacaccccttgagttacagataagcctttgaaacttttgctagttaaggagagaagacaaagacataaaatttctaaggattacaggtagggttcctttaaaggactttaaaaggaaaagtcctgtagaaaggcctctctccctacttatttactgcctaaggggatgctagccagatggacgtccacagaggagcttagactggcaggtggcattcagagtgtaaactgcaggtcctgggatggcctacagagtcttatagtgtccataggatgatctctatcatcactaatttccacttttataaccaaaaatggcaagcctatttggtcaagttttcataattaagagatataatttcattaaatgtattaaacccttcctgtgaattctgaatggttttgttttcattgttttgatgacattggagaagcaggcgaggtagaatttagactgcccaaagtcacagggctcacagaagaagtttgaacttccgatggttctgtggagaagaggtcatgagagagatctggcttcagtgtttacttgctcttttcaatttctacaacattagaagaatgatatacctggcttagcgactttgggcacgagcaaagaagagtgatggccaaggacatttggtcatcttctatcaatggtggaaaagcaccacggaggaaacactccacagagaacctggttctcctaagccaattaaagaggtgatgatggtggatagagttcccttgtagacacctcctatgactgttattactaattaagcttgtcctgttgacttaccagagctgtctggaataaggcagcaggagcttgacagacttaacgtatgaaaacaaaagcaagtgtgtattgcgttttttttttttttccctgtatgaatacactaaagcttgaagaagccagaattatattccatcagccaatatcaagccatgggaaaacctgatccactgaggctgagctatcaaaagattaatccaggctggtgcagtggctcacaactgtaatctcagcacttcgggaggccgaggtgggaagatcccttgaggccaaaagtttaacaccatcctaggcaacatagcgaaaccccgtctctacataaaaaattagtctggcacggtgacctgagtctgtagtcccagctacgctgaagggtgaggtgggagggtcgcttgagcccaggaggtcaaggctacagtaagccatgatcacaccactggactccagcctgggtgacaaagggaaacactgtctttcaaaaaagaaaagaaaaaaagattgactgtgatactctcgacttcagacgaaagctttctgcgtttagtcggcacacaagacagtgaaattttacacccacactgtgattaagacctactgtcatcccatattggaaagggcttttctttaccacagaatcagacatgctaatcccaatgccagcttaataaaaactagatgaagtgaaatacaaaggaaaaagtggtatggtacatgaaacatgggaaagagctaaagcttgttaatgtttgaggatctacaaacttggaatattttcacactgtatttttcatttatttctcaaatttgaagttaaatttgtttctaagacctgaagcaaacacagtcatatcatcatgcccattttacagatgtagaaatagaagtgctaagtagagcccaaagtcatgtagcaagccagcatcaataaagcttgcagtcagagcgcctgaatcccatattttcatctattaggctctactgcccccttcagtaaatacaatgagaaattaagccttacagttccctagaactgggttacttaaaatgcagttctgggattgatcactgtcagaatcatcccatatctatgaaatcggaatctcttgggtggatgccagagatcctcattttatagacactctcaaggtgattcttgtgcacataaaattaaggaagctttacctctaaatattcaatgatagagcaagtggccatacatatatatgattctctacaggcatacatgtgatattattgtgcccatatgtacccgtattgattccactttacaatatttcatgtagcatttccaattttagagataaatcctttccaatcacttacttttacatgtagggggcaataactaagagattagcttgtagcttttagcgtatgtatcctgcacactattcctctcagatttgctgcagttgctcccatttaatatatttggtcccatggtcccattgttccaatacgtaattcctacctgtcacaccatacatattttatacataaatacatctatctatctatctatctatctatctatctatctatctatctatcaaataaagtttggcctttgcaaatatggtaacagctatgttaatttttatcctggagaagtaagatgagggatgctgatttcaaaggagtggaagatgctggaaggatgcatgctgtcttcaaaatctaaccagggctctgagcaaattccctaaagatcacatatcctaatgtgttctgctctatgcatcctcctttgctacgtggtttaccatgatccagggaaaactcatccattaaaggaggaacacaccaatttcttttctttggaagttaaaataaataattgcaggcattatttagttaatctttgcctcttctgagactgttgagtcacaaacttgcttcaactctaactttcagataatgtcgcttctccctttgcttccctgtgccttggccccattgccttaaaaggatgttatgagaatggataatagaatatgtacaacataatgggaagagaacagcactggtagccaggcagtgagcctgcgagtgccaggttccactggcaagatgactgatttcatcgaggtatttccttaggatttttctcttttcaaaaaactaaattggactaaataatttcaaagccttcttttacaaggagattattagatgaaaaatagataggaagatacaatgtccgcattgcagggagattagtgtgaatgggaagctacaccagatgaccttctgatcaggaggttctactattctaaaattgtcattttaaggggaaaaaaacccaactctgcctggtcctttaattatgtatcttatgattttagagtctcggagaattaaatcagggaggagttagacaatcttgcaagcgtatattaaattgtggttaaaaaaattaaggagagcaaaagtcatttattttacaattgttggattctcccttattaaggggactaaaacctctttattcttacaccagagaagcaggacatccctaactagtctacacgaatggtccaaggtgaagttcaatataatcactggaaaagcacagtaatgaattttccaacgtctatgaaaaatctgtttctccacttcatagtcatacctcttccatggactttgtgaaatggcactcttaaaatggatctgagttcatgaatcagagatcaaaaacagcatgtgtataaatgcatattttagaagtattgttgcagggatacctatgcagatagaaggtgtatatataaacctgcacacatgcacctggcatgcagtaaccgcaggctcacataattctgcttcatagacagttctgtgatatcacaagcctgatttttgtgggaagtttcctaattctgtgaaacaattagtagaaactccagttgacagagaacagtgacctaatatacacaaaaggacccacatatccagaaaattcattgtataaatatatcttagaaatggaaaaaaagcaggcatattgctagactttagcaaatgaaacaaaaagtttttaatgagagtcctaaatattcctacatttaaaagatcagggaatcagaagaggtctttctttaatcacgtgagtgctctccaagacaaaaaaaaaaaaaaaaaaaaattaaaaacaagaatttggtcaaaagtaacagtaagagtaaatgttatgcctttctttacacaatattttctcctttatctctgtgtaacagtaattaattgattctttatatcattaccttttagtttataaacatagaggactgggttgaatataagtaaatcagtcactgaaaaaaaattaatgcaattacctattgtggttttaatttaagaatttggaaaaacacttaaatatgaatttaccaaaataatgtgaaaaaaaaattctccctgtgtgataacccactaagacagattgttgtctttgaacctaaacccaaagtggtggaaaacataatctaattacaaattaaagtcagcctggcaatactgcatatattttttagcagttcctaaaaaacctgacacaaaagagcaatgtgttctaccattcacaaatcactgtgtaaaattgtgtaatgccatgatctcatgtgggctagagactgtgggtgaatagttctcttaaagaatggtgaatgattaccttgatttactgtctttaatttgcaatcaagcaaactgtcttctgaggagaatggaaaaaggggaaacgaaatctactggccactgagagatccaaggctagtttttctctttcactctttgctaactaatgctatgcctttaattagtagattggaattctgtgagatcagaaagtgtgtgttacaggcagaaacctctgactgtggctaaccaagcactttggtgttgccgaaaatgtctttagaaaacagtgaaactgaaggccaagaataataaagtttctttaataacttccaagaaggctttcctatatatttttgatcttccctttactaccactgagtctttctggactgctgctttctcacaatgttttgtcaatttttttttccctttattaattggacctgacaatagtgagaataaaagagaatcagagagagagaattaacagaattctgctgctgatcactgattccacatccaaagttagcaccaggcaggagcaatctcatctttttatgaatgaagaggggcatctctaccaagatcagtgaaaaacagggagaagattgtgcaaacccaataggaaatccattcaggaaccttgacattcacttgctggattattagggcaatttaaattaaaaataaagaaaatcatcaatgaatgtggtggatgggatttcagaaaaaggcagcaaagaaacatcccagtagccaaagtcattagcagaactgttcagcactttcataaattgcatgtaaagtagttttaactgaattgggagacttaaaattgttctaacacaagagggaggaaaactcagccagggaaagaaaactcccactgggcaaagatggaaataatcttgaaccaattattgaaaaaaataattttacctgtatttaaaagatcctggattcatgcttatgaatgcttcctcagtgatcttgtgtggtaccttatttaagcagacccccacccccaaaaagagcaatcatcataaatgttaattttgcaaagcaacagtaactattcagaatcctggtcctggaaaacaaccgatcatatttcaatcaccagccatataatatcctctaagagcacctagcagatctaaggagatcatgtgtcaattaaagattttataaagcccttgtggagacacagatttgtagatatctgatgtctccatctgcttttttactatctgtgcacacattaatttgtcagctcttccagtctttctagccattatttagaggagaaataaaatcacaaatactaccccttcctttccctaccacaaaaaccatccaaatcaacaccacactattaccaaatacaaagtaataaaagagttatacccaaacctggtcagtccttccatttcttgaaacttgcacacaaactgaagaaacccactcagccttaaaaaggtcgatcattttgctttcctaaaatttcatctct

SEQ ID NO: 246 - DNA, 378738 bp, Homo sapiens
agcagtgcattaattattttattaatttcttctttttacattatgggaaacattcatctatttacaatatttttttgttcacacacaatctaggtaaataagcctatgaaattccaattcataaagccataaaaatgttcccacccctccatctgaaggctttcaaatgaatcttttttttccaaaccaaaataatttttaaaaattacatttgggaattcagatatgctagtgatttacattccagttatttaaaatatgcatctagacatgttttaaaaaagaaatggtaaattcacaaggataaggcttaaatgaaagtggtaatgcacagtaaaacattaaggaaacatctataaataacagaaatatattacaataaattagttctatttaccatttcaaatattaaaaatctttaatccatttcttcatctctctttacaaaaaggttatgtgaattgtatggaaacatctgcaaaaaatataataaatacttaatttctttgaacgttttttgatgtgggagacaaacttcttttgtaatccccccctccccaagaaaatgcccaacacctttataccaaagttaaacaaaataagtaatttttcagggtacatacattttccattacgaactaaaaaacatttctacaaattacatcaaaaagaacaatgtaacaaaggttatgctcatgaatgtcagtttcaggggtcaagcagcattgtgtggggtcatgttctaacaccaataattagctttttataaagtgtttgtacaatttaaattgtattttcaaggaaggcaaagatcatgatgccctgtaggccttgagctaaaagatttaaaattcttaccaaaaatagcttatgaatatacaaatgccgttcacttagacaagataaataggccttctcttgtctctctttaaaatatcatgggctaaattagtttccaaagaaaatattgtaggatgatcttgagtcgtattagaaatctatttcttaatccaaatctcaactctacctcagggcacggagctgtaattgtgagcatgggtcttgggatgaacgctgcttctttcatattaatctgtgagttccaagtcattctcagtattgaatgtgaccataggctacccaagtggcagttggccctactcgatgcaagctttgtgtgacttttaattgctgctacaaggtaaagaaaaggtgtattctttttaaaactagcaaatacttgaagctcaaaatctctgtatgctccaatttcacaaagcactttgagtgctttgttcaccctagttaaaagttggttcgttggtttcaaaataagtgagtagcccttttcttgtaaaccacagcagtaaacatttgtgccctgtttataaaggtagctcaaagcatcgatggctctgagaggtagcgaattctctagtggttttagaatatgtccgtgaaaatatctgttgctagaacccatcacctctcttaatttcataagtaaaattaaattagcacctggctatgagagtgtattattttaaaaagcttctctggtgcaagcatgtttgatgtatgtttttaaaagtctttcgtttttaatttctaatgctttaggatgttagctggacataaaatgccattgatacttaagattgccacatcctaagtgtttaaactgtgacgagtaagggcatttaaagacaacttcagctagacaccgatgcatactgcccatcaatcaagactaaaaatctaaatcaacactctctgccaaaagccttgacttctttcagtgtttatgaatcatgactccccccacctcttcatggctgttgaccctggcaggtcgagtttcttctctcactacctggaacctcaagatgacagcggcagctcttttgaatgaggcagcatgtctattggggcaaaaatttattttagccatttgacacaggacagaatcctatgctaggtattactggactctgcagtagtgagaggagatgaaaggagaaaatatatctgaaatacgaactacttgggttaaaatagacggatgtgtagcattcaaagggatggtaggaaaacccaaactcttctccaaaaacagccttgctgccatttacagcgctttataagcagatatgtacttatatatgtggaatcaggtaggcccacctggatggacacttaacaaattaatagaaccaacactttccctttaaaaacagccgccacgacaacaatataaatatacacagtacaataagagttgagaaaacatttcaggtctagattttcttaataatagaacaaaaaaatcccttatgtagtatactaaaccatcagtgcctcctttgccttgcttcatgttattgcctttcagaatagattaatttccctgaaagatcgaatttacaatcttctgctgattgagacatttgaagctgtgattgatgaagtaacagtgaggcagtttgtgcagctgtgagtgtgcaggtgcccccagcacctgcagatttcgcttctcccatccttgctacacatccaggtcccccacccccaggccaggcttggtcccctctctctgtgtccctcatggattccagtgagatggtgtgatttctgaggttgggaataaagtgctccatctgcttttttaaaagaataaccatttaggggaaataaagggaatcggaggcctagtttctttcacgtggaagacggtaagtcccaaaggatcaccctgtgatactggatttctgaaataccctatggttttatattgctgaacagactagctcgagagaactgaggacggcgggtgacctaaaggcatcacttctacacaggtgggtttggctttgcccagaaaataaagggttggatctcagtatgaggcagggcgacggcatcaggacagggggcgaagctcggtgaagaaggagatgggcaaacgggtacgggaagtggggggctgaggggggcccggggggcggctcctgcgaggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcactggaggaggggcccttctctcctgatcaaagcagaaggttcaggacattacacagcttctcaggacaagcttgggaaaaactgggataggtcagtagttagaacacacagttttttacctaggggtggttagttctgatctgcacactgcatatctacttttttcttcattattctggcttgggcattcaaaagatgcagaaaaaaaaaaatcccggtaagcttaaggcccagggtaaggctgggttgcagaactaggtctctccaagggaaggaagtgggtattttaaaggccccctgcggaaagcctgcggctcccagcacattgagtgcggttctctctggagactccagactcctcctggtgccagagatgggccaggaagcagcggctgcagcagcatcttagaacccctgcatcccctctaaggatgcaagtcaccgggtgcaagcttggttcagagcttaaaaacatctccgctctgtccccggcccgcccaccgtccccttcccaccaaacctaaataaacagaggaggaagaagagatatcagattgtgttctttagctttgttggtgctacaccaggttagacccttttgcacaccacacacgaacacacaagcaatatacaatatacagggtcacgggagagggaggccattgatatttcctacactcgagagttaattaagtcagttccaaggtgactctgactaggggcctcgggataactgtggtggcccaggaagcaattccaatcacaggggcagaaactgtgccatgaaaagttgacacaggatgaaagaggtcattcctcttatcagcagcaaactatgaaatgggcggatattttcaatgccactgcaaaaacaaaagacagtcatctctttggcattaaaaaaaatgcagcaggaaagaatggcgtctagaccacaaaggatttttaggcaaagaaggttgaagttgtagactgtgaaagggtgcacataaaactgatgttttcattttaaataaaataccctccattctcataaaatgaagcgtgaacattatcttaaaatatagtttcggtgattctccaaagagtactctttgtatcttaacaccaatgctcagcacagcaattcctccctgcttgccagagcaagtgcctagttcaacttctcaccctggagctaccccaccggctgtctaaggtggagtctgtgtggcttaaaagagaaaaaaggagagcctggagtgcaaactatattctcccaactctgattgtgcttgttcatttttctcctcaggttcatggggtgatgaaaagctctgatcacaggcaaagtccattaaaaaccgtaaaaatcaagctaactaatgatttactatgtaaatatcaataggttacatatatcaattcttagcatctcttcttttagacattttaaatcttcattgtggaataactcagtggatatttttagaaatatgaatattggatattttttagtcattttcctttccttatacatttggattttttaaacaatgattactattattattattattgagacaagctctcgctctgtcacccaggctggagtgcagtggcgcaaccacggctcactgcagactcaaactctccgagttcaagcaatcctcccacctcagcctcccaagtagctggcactacaagtgtgtaccaccacgcccagctaatttttgtactttttgtagagacggcgtttcaccatattgttgcccaggctggttttgaactcctggactcaagtgatccacccgcctcagcctcccaaagtgctgggattacagacatgagccaccatgcccagccaacaatgattatttaaaaaaaaaaaaaaaaaattagatgcatcagctctggaaactaaattaccagtatgtgtgcatttgtagtgttttcttaaaataagactgatttaaagcttatctagcagatagttttaaacacagattaaagaaaactagattgggtacaaatgtttggcttcccaagtgagaggccacatgtacatcaacagtactttccaacttaacactacgacccccattttgatggtgacagaattggaaacgggggacagtgatgagagcatcaccctcctgtcacttacagatggtcccttgggactggatttttcctgggagaccattgaccccaagaaccctgaaaacatgatatgcggtagcagaatggattagattgctgttagctttctggtaggtgaggggacctgaaaagaacagggccaccagcatttcaagggaacagccattccaattttcagaggttgattctcttggaattatttgacctgaggccataggaaagcaaagggttaaaaaagtcacgtttgacatgccagcctggggagctggacattggatacccgtgtgagcctcgtggaacaccataatcaaatgtgaaaattagagttgattaattaaagtaaaagaatttaagtctttatttctaaactgatgcatgaggaccccagtgagcaatattccccaaggcaaatcaaccaaaagcaaaactgttttgaaaaaaaaaaaaaaaaaaaacccaacatttatgtaattactgtgaaactttatggtatatatttttagacttgaacaacagtaatttctttattactatatttatgaaatgattatcaaagtcagttatttttcagggcatcctatttttcttgaaaacacatcctaggggtgtaaggaagttgaactcttgttctatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactcccatgaccatgctgatatgttatgaatatctctttttgttataactaggcctttttgtcttccattcctttgcataaagaatattacccattcaactagggaagtggttgtataaattatagtacaggaatataatggaatactttgccattgttaaaaagagtgtggttaacccacaagcatttatataaaacaatgtttaagacctaatttcaagtgaaaagagcaaattgtagaacagtatgtataaagaaagtttagacatgggtatatataatatatgcttagaacatttctgaaaagattcataagaaacagaattcttacctctatggagggctaaaaagggaatgaagaggggagggggactttaacacattattaaaatatttcttggtggtgttaaaatttttatgagtattatattttgtaataataaaaaaggaaatcttcccattatttctaaataaaaaagagacatgtgggtatggtgtatattggagaatggcgtatcactacggcaagcaagacaaaataatagcagcagcaacaaggagatctgacctgtggtattaggctgtttttgggtcactagaaagaaatacttgaagctgggtaatttataaagaaaagggttttaatcagctcatgattctgcagggtttataggaagcacggtgctggtagctgcttctggtgagtcttcaggaagcttacaatcatggctgaagatgacagggtgtcagcatgacacacggtgagagcaagggagcaagagggtggggaggtgccacactcttgaacaaccagatcttgcgtgaactcaaagtgagaacccagtcgtgttgatgaggacggcaccaagccattcattagggatccgcccccaagacccaaacaccttccaccaggccccacctccaacactggggattacatttcaacatgggatttggaggggacaaacacccaaactataccacctgtccttggttggcttttgatttttggtgtccttatttatctgtgtaacttcgtatatcagccctttccggtaccatcctaatctctgcttctaccattctttccctgcagcagtacaactttctcttgtctcttacttgatttcaaactgtctccaatttgtctctctctatctcatctagaggcaggctagtatagtggttgataacatgggctctgaattcaaatcccgactgtgacacttctagctctgtgaccttggaaagtcaattaaatttatgtgccccagtttcctccttgtataacctagttaataatgattcttgtcttataggtactattagttattatgtgaattgtgtctggcacagaggaagtgcttctaagtgttagtcattactattcttcaaggtgattttttggggggttaaaattagatatatttcaacaagaaaaacaaataaagaagccaaaagaaaaaagtaagagaaaagcacaagaaatgcagcaaaaaccacccagaaagcctcttcacgagaagaatgactgctgagatgttagaagatatccttccatacatatatactcatgtaaataatatagaatatactttcatctaaataagaaaaaaaatctctcttgtaattggctttttgactccacgccacgcaggccatctgtgtttttgtttgtttgtttgtttgtttgtttgtttttttgagatggagtcttgctctgtcacccaggctggagtgcagtggcgtgatcttggctcactgtaacctctgcctcccaggttcaagtgattattctgcctcagcctcccaagtagctgggactacaggtgtgtgccaccatgcctggctaatttttgtatttttagtagagatggggtttcaccatattggccaggctggtcttgaactcctgactttgtgatccgcccgcctcggcctcccaaagtgttgggattacaggcatgagccaccgaccccgccacgcaggccatctttctaaaacaacacttacatcacttcattatctggctcggctatcagtggtttcctattgctcactttattaaaacaaaatgaattctctggatatgtaaggatcttacttagaaaagtcctcactttctatccaaagatggcttcccatttttaaatactcttctaatacatcagtcagcttaatttctttatactcagacaaaattcctcctccgtagtctgttgcctctcagtgattattcagattccaaatcgaatcctttctctttcatgaagtcatcccttcctattttcaattcctattagtttttcttttttttggacaaatatagcacttttagttagcggtaacatacataatgtaatttcaaaacttacaaataatgatacaaaattgttttcattgctcttggcggcactgaatcgtatatgtgcagtggagacagagccttatagctctcttgtctccctcagggcatttagcagcttgaaaactttgattcctctggaaagaagtcttggttgagagtgagatgacttgggtcctaaaccttgctgaagagcttaagcgaggcacctctttacttggggcctccatatcctcatttgcaatataaaagggttggaatcatctttgaggatccttttagttttgcttctaagattttttattcattctctctctgaagaaaggctacctaaaaataatgccattggtaaagtggtaaatgtttagaaactgactttttgggaggaagaagctctgcctcgtagagcgtgtcgatttccatggtgtaaatatttccatcacggccaatatcaggctcccaggatgacaaaactgaatatggagttgggaagagatgtccaccattggctctcattggacgactggaccccccctagcattgtggagtggctcctttcaatgaagaaatgcagcctcaggctagatgagcacagccagctagcttcgtctccagcttctctcactctaaaactccaacacaatctttcttcactgagtggagaaggcgacgacaatggaaagtgctcccagcttggcttttcaaacccaggctctgaaggcacaaaccccaggaggaggccagtcttctcaggcacttgtacccacagcagtgtccatctcttttggaatctggcacaggaatgatgctaccgaggtggtggcaattttatatgcagttggtaatttggatctgttccgagagctctcagctctgccttttctgggaaagaggtgtggtccaaagaactaaaagaaggttctgagctgtaagtcaagaacaatgtacagatggtggaaacagtctccagactgttcagggaaaagtcctcagagtttcatgagtcagtgggaggaaagaagttggagagaaagtagagggctggagccgaagacccaggctctgcctcgtgaggctcacaaccatgagaaagccttggtgtatcagtaaagtgttggttaaaaatcaactcgaaattccttctgacaccgttgggaggatcttatcatatgtactaaaaacatttgatgactgttatttatacttatttatgttaaacaataggaagaaaattaaaatattactagctatcaggatagatgatattttctcttcattggtttatgtaggttcatatatatatatatatatatatatatatatatatatatatatatataattttttttgagacagtctggctctgtcggccaggctagggtacagtggcaagatcttggttcactgcaacctctgcctcccgagttcaagtgactcagcctcctgagtagctgggatcacaggcgcacgccaccacacccagctaatgtttgtatttttagtagaaatggggttttgccatattggtcaggctggtcttgagctcctggcctcaagtgatctgcctgccctggcctcccaaagtgctgggattacaggcatgggccaccaagcccagccacagataatttttaaagaatgttgcagtagttaatgtgatcattgaagaacacccttcccaacttcaaaaggactagttaatgctggtgctccctgccccctcatagaactagaaggaactgggattccccagatgaactgaaggaaatacgctaatattcaaagtggataacaatactagggatggctgcgtggatatttttaacatgctaatgtgtacctgccagactgagctcccagcctccaggtgggctggcaatgcaaagtagggttgagaaggaacagggagcttttcagagaaccacagattcagaagcagagggagggggaagaattgaagagaacacagacgcagtgaaaggatgctgggcagatgttagatggcagctcaactcaaccactgcgcattaaagttactcatggagggtactgttcagggcactttaggcatagagggattgtgtaatgatgcgttagcatttgttcaacatcccctctgggatgacgactctgtgccaagtgcttcaaaaacattctttcagatagcattgaatctcttcctacacgagggacagagaaaataaaccagtgcttaagaaagctatattaccttgagaaatgttaacacagtgcttcgggaattcttaggaggaagaaataatggctgacagccagaggttaaatttgagaagaagatttaaaagaatggagactttcttctcatcttctcccccattagatcgcaagttctgttgtactgggaatcctgactactataatatatcccaatgcttagcacatagtaggtggccaaaactgataataatgatggcgatagctaacatatgtggagcaactactgtgtgccagggactgtgctaagtgcgccacatacactgcaccttctcgaatctgcataattacccttgaacaaccagtggcttgttgaagtggcgtgatgttacttcccatacaagtgttctgtgcttgtaagggaatagcaggaaagaagatctcaaaggagaatggtgtcttactgtgacacttttgaatgttacatttggaactttgtgcctagacaacatgggattcagagataattttttagcaacctggtagaaagtcttagagaaggagttggagcagagagaggctgggggcgtcaatacaaattggtccattgcaatcactcaagtgaaaaatagtaaagctggaagaggtaagaggtgagttgcaaagtttcaagactgtatttaaaaaatggtcattccactgatagaaagggaagtgtcaggaagagaagtgatatatttagggagtactgtgttatgtgggtgctttgaaatctcttcttcctgaatgctgagcttgaaaatacaggatcaatgcacatgatcagacgatggtgcagatcttatgctaaagtcttagactctttaggctgtaaagatcttatatagatattttgtctgtcttgctcaggcagaattatcaaaggtctcagaggaatataactcagcttgtttcaaaagaggccttggaagttttctctaacaatttccaaattaattgatgtgataattaataactttgcacttagaagttcctccttgcagctaacctgaattccttgggctgcaattttgatctcatttcctcctggtttatagataggaatgttgatgatgttgctatttcaaatgcatcttctgtaaagatacatttatttaggacttacacccagcttgcttctaaaaaggattagaggcagctcctaatatgtccacctaggcttccttttaaagaagcttttctcattcctgcaaaatgtcttccatctgcatgcataagaagaatttctttaataataaatgatacagcaaaagtaaagctaataacgaactatgctgacaaaatagtaacctgtaaacaaaacaaaacaaaaacaaaaagaaacaaaaaaccacaatcctttcttatgccaggcaatgcagatttttctcatcagaaaataattttgaccaaaactatcaattttaacaccgccagcctctgaattttaagttcctttcttctttgtagtgcctgcttttgccattcttagactcgtgtgtgtgtatgtgtctgtgtgtatttttctcttccacttgactctggaaaaccagattttagtaaagcatttagtgaatattgaaaccaaggtataaatgatggacacagtacttaaattattaaaggtaccaaatgtttgttgcatgaataaatgagtgagtgagtgattgcatgaatataatttgtgattgtaattagggtgttctctttacctcgttgtctgcactttaacgggaacatagatattaaattgaataaatggcaggtggcagacagaaaagacgaaggaattttgaggctctctgcaaagagaagccgtcctggaaggacagtgggcagcatctctgatcagcactacctaaaggaagtgaggagtctttgttgccagaaaccttagccagggccttccctgctcccctccctctgctgtcttagggctttgtttacacagccccttgaagccagctgtcaagggtgcaaacctggtctgccatcctttgaagaaggttcaggttacacatggtaagccacagaacagagaaggcccaggattcattattgtattagtctccacagagctgaacccaggctcctaagagtccgtcccttcttcctgtgtcctctgtcagccagcgccttctgcagctctgatcctttggtcattggtccttctttcctgcacctgaggctaagcctgagtcaagatgttctcaagatccttcctgtttcagctgcatgtctgatgtttacacttgcgactcagaactcacttcactgcaggcttctgacgccccttcaaatccatgcttcactctcacaatctgttttgaatgtctgtttttcctgggtaccacttctcagttgtccacacccagttgatcttcctttcccctccattattaaacatcttttaaatagctcatcactgcagtcttagtaagttcaactttccgtccagctttttatcttttctggtttcaacacctgggctcaaatcttagctctgacatttgattgataggtaaccttaaaaaagttatttaatctctctgagatggaaatttgtcatttgtaaaatgggcaaaattgcatgcatagagttctgatgatcaaaagaaaacacgtatgtaaagcccgtagcactcagtcaggcacttagaaccttgttaaaatgtaaatatccctcctacttaaaaaaaaattattttaagttttgggatacgtgtacaggatgtgcaggtttgttacataggtaaacgtgtgctctggtggtttgctgcacctatcaacccatcacctaggtattaagcccagcatgcattagctatttatcctgatgctctctccctcccccaatccctgactcttaacttttaaaaatgtctcattccttctctctagaaaagtatcgggactttcttttattcttttgcctcctttaaaggcacacaaggagttctctcctctctatagtcatgatcattgtagagacttttcagtctacgcaggcttcctttcaacacaggcttcctttcaacacaggcttttctaaagagtaattatatagcaagaaaccaggatttggtacagactacaatactcacacatgcccacatcatttggaggagggcattcatatcccaatgaaggaacatttttttaaaaactaggagtggtgatctgggactcaatgtaataggcgattgcttgtattagctgtttttttcttttttaaataaagctgatttctaacaaatatttgaaaggtatttagataatttgtagatgagcaagtgataatttttctgtgagcaagaatgactttccctgttttaaacgtgtcgcgtttcttattatattggaaagtgggagtggggagttagaagtatagaggataatagaagaaagtattatagtcaggtcgcgtttcttattatattggaaagtgggagtggggagttagaagtatagaggataatagaagaaagtattatagtcagggaagaatgggacactaccctgggtttatatcactgatcactgaggacgtaaattcacaatttcgtgtggcaggttgtattttcttgttctccctactttgtgaggagcatttgctattatacgttacaatgatacggaggaacaggtaggagaggaacaaaaaagcatttaggcaaaacagagacatttcatactacttagaacagagatgggatgatacaaattgctatgttcccaatacagttcatatctttggggaaaaaatagcgatgctccaatcttcatcccatccccctctttctctaacaagaaaaggaaaacgaggagcagtaggtaggtaggaggggagtgtatgacgtgaggaacaggcaaggacacagcatgtccaggaggagaaaaggggagcaaaaaacgtatacaagataaacaacaacaacaacaaaagagactccagcaagaggctatggttttgggctcctcacgtagaaatcaatgcatttaaaatatccagaattaaagttgaagaagaacactccatctacctcttctcaaattattttctttaccaatactacttccttttgtctttaaactgtgaaccactactctactgtgccttgttcttacaattatacacgtcagtgctgaaaggttcctgggagacatttcctgtagactaaggatagcacctgtgggcatctcggatcgatgaatcatggtggctggagcactgcattgagactggttcaggggctcagtctgttctcaatgggtagggtgatggaatccatcaatgctgggattggctaatgctgtcttccacaggtttggggtgggaggagttgtagggagagccgcccaagtggtgccatccacgctaagagactgagactctcatttacgaggaggttcagagacattaatcaatttgccaaaaggcacacagctacttagtatttttccaaatttaaatttaaatttttccaatttatctaaaacaaacaaacaaacaaaggttcagggccagggggaaaaatgaagattaagaggattaaccatcctgaaaatgaaaaatgatttgccttcaaggcatttagaactgaaaataaatcttcctgaagccttttgttagacactttatcaaaattgctaggagctctgactggctctcttgcaacagcctggaatccttctccccagtttcagaggagtttcaaaatctgtaatattatagactgactatttcttccagggggagaatttttcttagtgcttggataaagagatgaagtattaagacactttaaactattattcatgtaggattaacagatatttgaatttaacttcagaatcttttaaatgacaccccacttaatataatttttaaaaagttctttctgcagtgtatcaaataaaagtcccagatgggatttggacttggttttaactaatcatggtagcaggcagtagtctcagttctagaataaatggcactccaagtaagagacttaagttcttcatcagtgccaggctgcaacaacatgctttgagggaactctggcccctaaatgtctcctctacttgcctggaaatttactattaaacattcagaatttttttgaaaatgctaatattcttgggtgatacgccatttcaaatttattgttagctaataagtaaggaagaaggaaaagctagtgatgaggtggagtgatttgttaatagctgtgggataagagaagagagtgaccgaaataatagttttccaagagtagctacaggaggggttttgctggcccaaagatggacttcattgtctcaaaactactcctaacaccagaatgtttaactgaccttaggccttatatgtctgaggacccaataactaacactaagcagctgatgaaaaaccacccacataaataaaccctcaagatgccttcggaaaatagaaaagaaaagagaaaaacaatgtaagaaagtgtaggagtgccttctcttcaacatttctgagagaagatgggagttgaaaaccttaaacaaaatgttgccccaatctcacttgcctaattttagttatcttggttcagggctatgattcatccctaaagctgtgaattactgaggaggaaggagggaaaaaaaaatcgacttaaatgtcaaagaagtaggaacataaatatagttttcttttttgaggaactagaattccaggatatagggatcttttttctcataagggactgaatccttcaaacttctagaaaaataatgatctgcagtcaaaacatcatcaaggaatgaaagacagaattgattatgagtcatgtcatgtctgaatttttgcctctatagtgtattttcctttttttcttttgtatctctttcaatctggttaaactattaattaattaattaattttgagacagggtctctctctgttgcccaggctggggtgcaatggctcaatcatggctcactgcagccttgacttcctgggttcaaatgatcctcccacctcagcctcccgagtagctgggactacaggtgcacgccgccacacccagctaatttttgtagtttttgtagagacaaggttttgccatgttgcccaggctggtctcgaactcctgggcccaagcaatctgcccaccttggcctcccaaagtgctgggattacaggtgtaagccaccgtgccaggccaatctggttaaactagaggtcactaacaattgtatgcagttgaagatgacggaggtttaatgtgtagactgtaatgacaaagggaactcataaaataggtgagtgtgaaacgaatggaggtaagtggaactatgagaaatgattctaggggatgtgatggtagcacagggaaggaagatatgtttgaatggttgtctaaggttctcttgtgatccttttgtggatcataatcataatgattgagttttcacagtaatatatgagatgtgcttccttcaaaccttgttatgatgttggcacactatccgtcttacataaacataggaaaaaaaagttctctttcctgccaaagaacaggggacaacagaaatggtgtggggaaactccatcctaagtaaaatgttttcaatttagtaggtgttctcctgtccatttatcaccactttgaatttctgtaagtggggagggatgaaatagcagtcactaactcatacccagttcaacaacttcaccgtctgaaggagctgaccctctaccatcagcctagctgtcatctgcatgtttgcctctttctgctctgaaaacttctgagcagtaaaagaaatatatggtggtcacaaaaatacggtccaggacgttggaggagggtcatattgtgaagaaggcaaatgagaaagaaagagtttcaatgacttcagagtgatcctccacatcctgaagctatgagagtagcccagggcacaattgtgacattgatttcagcccctaccctctagccctgtcctcagtctcctcagagcactcttctcatcttcctcatggctctacatctttctgttctcctcttacctgggtattgctgtggacaagagcaattcctctatcttatcacccaagacccaaagtgtcactcagtgaatgtgaccaatgcatcttgatgacaacctaacgggatacttaggaggtggaaaggactctggaggttgccggtttaagtgactttcttgcccattgcaatccttttcttgcatcttctggaagatgttaaccctatggccatgactacctaacattgtgtctagtggagagatattttaaggtccatagaagaatttttttttcagaagggtccttggcctccctcatttcatgtcaccttggtccactgcctttcttacaaatccagttcttctaatttaattttctgagcttctgctaggcgcgccaaagtgcaatgaagacttgtttctgttttttatttccacgaatttttttttttttttaccttgtgtggcaatgttttgggtccaattctgttctccaaatagatatattgaagtcctaactcctactatcggtgaatgtgaccttatctggaaatagagtctttgtagatctaatcaagccaccaagtttgtggtagtttgttctgatgattcttgaaaagtaacacatgtagtaataaaggcaaagaggaagggcaactggaagccaaagaaagaaggaagaggtttttttcttggcttaatttactgatgcactggtattaatttttgattaaaatgatccagaattgttccacatgaacccttgaaaaataattcatgggaggccgtctctgtccggatctttaaaatacaacatactctgctatttaaataaattcccatcgcacaatagtcagctgtttttcagtgctcttgattaacaattgggtttgttttccttaactcgactgctttgattttttgttttattttgccttttaatattttatttagtaacataaatgcatgaatagtaatgttcatttcatcaaaatatggaatcaaaggcacttaaaaatacgaattatccgtaatatatttttcaggtccaaatggaattctatctatttctacattccaagactctaaagaatttactctctataaacagcatttagaatgaaatcaggtcttgcttaaaataatcaatctcagtggtttcctgcgtagcgctattctttgtttacaaacagcacaaatacagttaaggactacagtcatatgctgcacaacgacatttcagttaatgatgcatataatatggttgtcccataagattataatactgtgtttttactgtatttttctatgtttggatatatttacataaacaaatacttaccattgtgtgagagtcgcccacagcattcagtacagtaatttgctgtataggtttgcaacttaggagcaataggccactccatatagcctaagtgtgtaataggctagaccatctaagtttttgtaagtgtactctatgatgtgtgcacagtgaaatcgcttaatgatgcatttctcagaatgtagctccgtccttaaatgatgtatgactatatttatatttgcaaaacaaaacctttttaaggccttcaattgtaatacatatcgagtgcccaaatttaaaaatgtatgtcaagaaccttcacatatccaattttaaagcacggtcacactctataagcttctctaagacaatctcttctattatgttactcaattatctgaaaaattcaagagtcttaagaaaaagttcttgtgtgtacttcgtgcctgagcaaacgttcaagaattgggatacatgtatattctcattgaccagaaatttcaatccttttcagaagccattctggattcttttaaatccagaatggcttctgaaaagatgggatttcttctgcttcttagagatgaggggttcagcttatgatcaatgcagaacacatctgttgcctctctctacaaagggactggggtacggacgtcagatctaaagtcacaatcaatgtactgcactgctccacctgtaggatgtttctgccccacttactctaggagacacaccatctgagcctcggtgataatacaagcacctggactatcgcaagtgcagggttaggactactcacttgagtgtggtgagttctgtaagggatggctgagtagccttgagatagctttctctccgcgcagcaacttttggagaaggcttaggactcgtgtctgagtctccactgtcttcatcccccatggccttgatataactgccactccgcattcttcggcatggaatttcatcatctttacctcgtggggtgtaccctgtccattcatcttgtggaacctattcagatagaaaacagataaatcactttttataaaagcctacctttttcttttctttttctttttttttagatttaacatttctattttttttttttttttttgagatggggtcttgctttgtcgcccagactggagtgcagtggtgcaatcttggctcactgcaagctctgcttcctgggttcatgccgttctcctgcctcagcctcctgagtagctgggactacaggcacctgccaccacgcctggctaattatttgtattttcagtagagacggggtttcaccgtgttagccaggatggtcttaatctcctgacctcgtgatctgcccgcctcggcctcccaaagtgctgggattacaggctaacatttctaatttttatgagtacgtagtaagtgtatatatttatagagtacatgagctattttgatacaagcatacgatgtgtaataatcacatcagggtaaatggggtatccatcacctcaagcatttgtcatttctttgtgttacaaacattccaattatcgtcttagttatttaaaaatgtataaataagaccaagtattttctttttttggtatggtgctggatattggtaatataattatctgaaactttagacattaacctttcaataacaatattttattgtaataggctcataaatattttgaatatgtacaaatccacgtctctcagtctttaacatgactcatgtagtaggaaaaattaaaaccattggctttgaatcatttgtacatctcagttttctcatgctgataatagttgagtcaggcataagaatgccatttgaaaggagagcaattttatttgagcttttcagtgatttgttttcaattgccatttaagattcgggaatgtttactgattgatctatgccttccttgaacctttcgactttaccatctcatatccagtctgtcttcttcctaaaccagtggtctctaccagctgcatttactccccagtcacttattctttctgaatctttcttaatttggattcagcttccttagatctgcttaaagcactctctaaaggtttccaatgatctcctaatggaagataatggcattttcttgcttttattttttcttggcctctgcacacccgtgcacacacatacacacaaataacacctctttgcaagtttctccccttttggccttctgattgcttgacttacctggtgtagctactacttgtctgaattgttcctttccttttgctttgctggatcctactctaagtccctaactgtggataccacaacaaaatcatattgtcagtgcactgctcttcttttttctttccacagtcattttttctgagttcagcagagcactgcactacgttttagaagccatcttcatgactttctcttcagttcctcttagattttccacttcaacatgaactcaacctagatctcattccttcttcatttttcatgacgtgaaaaaaaatgcataataaccactctttttattcattaagaagtaacatagcaaacatactatagtggacagagcactgcacaaggcttaagtaaaagagaccaaaaaacggggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcatttattaattatgctagtaacaatgtaatgtttttacttttgtaggtaaaagcatcaaaatcaccacagcaacaaagatttctcaggaaattataaatgctgagaacagtcttgttttccttgcattggcaggtgactcactgcatagatatgatcatcttcagagcctcattataggtttagcaattacattttaaaaattaacttggtacagctgagggtcatagatgacgcacaccacacttgctatttctcaatcctgatgtgaagttcataagcattgctctctggagtatgtcagagactaatgacaaactgattagctcatatggcttatgcaacaaaacatggcaaattttgttcagatatttttttcaaagttagtttatggtagaaatttgggctcatactagaaacagtctgtaactgttgtttagggaaccagctgagaagtatttaacctgtgtatctttcaattaatcttacttttcaaatgatagcagctaagaagttatgtggaagtgacttccattggagtggaatttgaatagtaatacattatttatatacctaaaggtagcatacaacaagattacacataaaataatacagtaatccgttctagggaaagtgtaaagacagaaaatcgagaccttggagaagaaaaacacaactgctgaactgtaagggccattaacatcgatataatcgagtcagtttttagtttttgtttcttaaaccctaaagcaaaagggagacattgcttaggtagatagttttagaagaaagcatataaagtgataagcataccaggcccaaagagtgaaatgttactgccttttgattgtaaagaaagggagaattacatggctgcagctgctattgtgagctgggcagaggttgctgtgtctttccatttcagctgcacagagagaaaagatttaggaaaatccaaagaaaaagataaccttgcagctgtctctgaaaagcctgcgttattactgtggtggcagtttcaggagctggaagtcttggtagaaggaaagctggagcagagacaaagagtgcaggtcctcattgatttcaggctggtgggatgccctgcttgtgtgcaccagcttaggagggggttggactcaacaaacataaacaaataataataaaagcaaactaatacaggttagattttatagtagttatggatgagaaaaaaggattaattgctttttaattattatgtttaagcattagcactccaacagagatcttaatttttgatgaaacaaaatgaggattagtgtgcattgtctatttcagtggtagcccgtctataactgaaaccatatgttatcattcagaaaactggaagacctgcccttgactaagaaatggccataatcaagtgctaacatcctctaattacaggatagggatgtagggatggtttttttttttttttttttttttttttttttgagacagggtcttgctctgttgcctgagctggagtgcagtggcgtgatcttagctcactgcaacctccacctcccaggttcaagcgattctcttgcctcagcttcttgagtagctagaattataggcctgtgccaccatgcccagctactttttgtattgctagtagagacaggattttgccatgttggccaggctgctcttgaacatattgaaagaactatttcaatacctttttttttttgaggtggtgtctcgctctgtcaccaagactggagtgcagtggcacgatcttagctcactgcaacccctgcctcctgggttcaagagattctcctgcctccctagtagatgggactacagatgcccgccaccatgcctggctaatttttgtatttttagtaggattggggttttgccatgttggccaggctggtctcaaactcctgacctcatgatctgcctgcctcggcctcccaaagtgctgggattacaggggtgagccaccgtgcccagccaggatgagaatgctttctgaattgaaatgatgtcactgcactgaaggatgggctctgctggaagtggagtatcttttggtgctgacatttccccccactttaggttttcctaaactcagttgaaagaggaacacacggccggacgcggtggctcatgcctgtaattccagcactttgggaggccgagacgggcagatcatgaggcaaggagttcaagtccagcctggccaacatataaaaccccgtctctactaaaaatacaaaaaattagccaggcgtgatggtgggtgcctgtaatcccagctattcaggaggctgaagcaggagaatcgcttgaacctgggaggcggaggttgcagtgagctgagatcgtgccactgcgcattttactgaatctaagatactaatgcaattgtcccaacattttttgtgtcactaagaaagaaataaacatcatcaataaattctgacactccatagaatatataatttatcccaatatccaaaatgctaaaacgtgtaaactatggctcttagaatcaattaaaaaccttttaaaaatatgtatgagaagaaaaacaagaaatgaatttattctgggatagtaattgttgaacttaatgttcatatttagtaatgaccaaattaatataagcaattacatttatcatgtcatgagtttggaaaaaaacataagttcacataatgtcttatgatccttacaactatcatgaaggatatgaagagtaaatattataacctcagtttgtcaaatagagaaactgaggtcaggagagattagtaactagtgtagggtgacactgcccaagctgaggtctgccattcacagttcaggaatctcccccgcccccttctagcatattcatatatgtcttttgacatgtcttttgggtaacaattgttattttttgataaactacaaagcacatattttagataagaaaataatatcatagtgttttaaggtctgtttgaaggaaaaaattaataaacaaatagtgggttacaaccctttgaaagaaaagttacaagaactactctatcagatgtaggaacgcttagttttaaaagtctctccccaagggcatctagcttgagtgccccactttggctgggctgcagttatcaaagtgtagctaaatagattacagtctgtgccaatgatggtctgtgagacgatgattgagagatgaagccatgtgcacgtgactctttgagagcggattatctcaggatgggaagttgcatggtgaggtgtggagtaatgagaatgcgtgagattttgggaaatctgagagccacaaaaggaatgaagacacttagaaagccgggacagctgaaatgaagcatatgtcctgaaaatatacaagggcaggcctgtgcgattctgtgagctattctgggttgcagagatttgggaggaaaactgatgaacccaaggctgtgagtacataaagcaaagttctatttcatcaggaaccaaagaactgggaggaaggaacctaggcatttggttgatttggtgaaaacaaaggcagtagagcaaggaaaagtagcaattgaatggtgggcatgagggataggcttctatttgcacagttacccctcagcagctgttgattccttcccaagcacaaggtatttcaatgacagcagccaggtaaataagggtgcttggcagtgacttagggatcaacctgtttgactttcctgtgcttgaaaaggaatggtaaataggaggagaaaaatgtacattatgaaaggagagttgggcatctgacattcatgaaaaaatctgacaattatggaataatctcaatgagctaggggcagtgcctatgttactttatgttaatctttgcagcagttgtatagaataggcattactatttccatcttactgcttcaaaattgagattcaaaaaggagagttaggcatctgacattcatgaaaaaatctgacaattatggaataatctcaatgagctaggggcagtgcctatgttactttattttaatctttgcaacagttgtatgaaataggcattactatttccatcttactgcttcaaaattgagattcaaaaaggtaaaatgcaatggctcatgcctgtaatcctagcactttgggaggccaaggcaggaggatcacttgattccaggagtttgagaccggcctaggcaacatagcaagaccccatctctacaaaataattttttaaatgtagctggtgtggtggtggtatgtgcctatagtcctagctatttgggaggctgagacaagaggattgcttgagcccaagagtttgaggctgcagtgagctatgatggtgccaccactctccagctggccgacagagtgagactctgtgtcaaaaaaaaaaaaaaaaaaaaaaaaagatgaaacgacttgcccaaggtcataataattggtagaaatgtgcatttgtctgacatcaaagcttttaataatattaccttgcctctgatgaatccgtgatgattaagtgaatgaaccaataaactaaaaaaaagaagaagagaatggggtgcacgctcccactcaacagtcgtggtttttaaaataaaatgtaaccattcaaataagcataaacgttctcgtgtcactaattttctagcactgctaaaagagggttcaaaataataaacacttaattctgaagtgaaagagtgttgttgtttcctggtctggggctgccttaccaagtattgtttgcagctgctgtttaaacaagcatgaacagtttggaggagggagtgggtgattagaaaacttgcaggacagccacacctttaagggtggcttgggagccttgaagcatcccaacagcgttttagcatttgtaagaaggctccaccctggactttaggttcctgcctacaactttttagagaaatggctgtaatgtgttggccttctaagcacttttagtgggctctcagattccctactcactcgatttctttgcatcttctttgcagctgggagaactgcttttctgctccacacagctttcaccttgacaaatgcgacttggcttaaatgtccctttagcctttttagcttgctcttctcatagcaaaaacagaaaaaaaaaaaaaaaagagcaagaataggaaaattacaattatgcaatgtgcagatccctaggcatgattgttgcttcccaatcaggagaagatttccctggcaaccgccctttcttactcccctggaagcccgaaattggtggaaaacttaatttgttttagattgcttaaaattaccttttaaggataagagtaaatacctacctctttaaatagaatttataccctttgtcacagctcttccaaataacatttttaaatgatcttgaaagaatagaacattgtaaacagtgatacatacggtaatttgcttaccatgaccctgtagaattattcttacccacaaacatttacagtatctgcagggtacccagcaccatagcaggggctgggtaaatacaccaaaagcattttataaaacacagtctctggtgttaaaggagtttataagttttgagtggatctggtgaatctggagggtggaggaaggaaacgagtaaagagcagctttaagtaagtcaagctgagtcgagtattaaatctcagtacctctgaatttcctactgggtttgaagcttgttcccataaatcccctttcctggtgatgaaactgttccttaaaaattgaacatatgtgtgtgaagtgcaaatgccactgataaatagccctgcaggggaatggcagagggcctaggtctgcagtccccaagggattggggagccatgggcctttggggactagtagaaaatgttactgaggtgctggatgacatcaaaaggggcactaactgtggataagacactctcgtgatatcacatcaagaaataataactaagatgctgggtgtggtagaatgcacctgtagtcccagctacttgggaggctgaggtgagaggatcacttgaatccaggagttcaagaccagcctgggcaacacagtgagacaagatattaagattctagtatgatgtagggacaggaagggaaatgaattttattaattattcacccactattttgacggtagtgaatacgtataggtttagctatcccagttccacttctggttcttgtagccaagcctcctgattttgctttgggaaaagctttctcctcaattcgaggtccatgtatttcaggagtagcccaagagttggggtaggacaatcagcaaatcacacttcctggcttcattgcttggctcagggcagaggtgaatgatctaagcttactcagtcagcaagcatctctggacctgtgcatgaaatgccaggacaaagatacctcctctctcactgaatatattaatagggatgcatgtgaccttaggacttgtcggtagccattttataacatctaatacacaaacataatttcacgtaatacaaaaaccttatgttatcttaatgccattgcaatgatgaaaaaattgagacttagtggtattaaataacttagaccaaatgttacagcttgtcagaattgaaagacaggtttgtcttactcaaatttctacactcttcttcacaccaggctgctgtctataagagtttcaaaactttgttatagtaattttctattaaacctaaaattcaagtgttaagttgctgagagatacaatcccatagcattttggaacttgtaacaagtactgagtgttagatgcttggcccagcactttgggaggccgaggcgggcagatcacctgaggtcaggagtttgagaccagcctggccaacatggtaaaaccctgtctatactaaaaatagaaaaattagccaggcttggtggctggcacctgtaatcccagctactcaggaggctgaggcaggagaattgcttgaacctgggaggtggaggttgcaatgagccaagatggtaccattacattccagcctgggtgacagagtgagactccctctcaaaaaaaaaaaaaaaaaaaaaaaaaaaaatagaggtctaggtctatggtaaatatattttttccactgactatataggagataagctaacttagagcccctttttagtttttaagataacttcattttctggtgtattggaggcatatctgttggcttggaattgttagttgagccatcatagctttccattattgttatagttactagtgtgctggtgtctatccaccatatcctatgatgtttgtggctataattcctagttgcaaacattgaattccctgaggcaaactagaattttgtgtctggtgttcagaagcagagatgtgggtagaagattagtgaccttcctcttgctgccaatagaagcccacatgtggaaacatcattcatcaacactaatccttggtgttgtctaaaatcacataaacctctcagcacatctgtctgttgctatacacacccaactacttgtcaaacttgtatattaattttttccttaggacacaaaatctgataatgttattattaacaaatagtatagctagagtctataaaatatcaagtcaatcatctcaagtattaatacttaattttaaaattaaaaattttaaaaaaggtttcggcaaatattttcctttagtctattatcaattttgaaatattaagtttcttaaatgaggcttacttgtgaatcattaacttacatatttgacatttataaacaaagaaaaatctcaatagatttaagaagagacacaactcagagcctcctgcttctcgtcatcatcatctgattcccactgcatcttggggctgtttggactttttattccaagctacatttataacacctgaaagcatacggcattcaaacgggccaaaataatctttccttcctgaatcccatccattctaatgcaatgaaaccgtcaaaccacatgcatctagttcttgagatcgggaaaataactgaataatattttggtgtcctcatgcacatgtgtgattcaaaattccactttcataatcatcatacagggaagttgcctcttgagggtgtgtactttaagctacgtttcaatctactttccacaggcagcaagatatctataatgaacagaggatgtcccacaaacatgtgtacagatgagtatgatacactcaatagttatccaaatcagtgcttccaggctagctcaaggtccattgaaaggaaatgttccaactggagtattcattacagggttctcttctttcactttaaactgattactttgtggttaagctggagttaaaagttccacttcttctgtgactttatcaaaatgctttagaagtattcattcacttgttcaacacatatttattgagtatatacagtcatcctatggtatctgtgggggactggttccaggataccaaaatccgtggatgcttaacttcctgatataaaatggtgtagtatttgcatataacctatgcattatcttcccatatactttaaatcatctctacattccttgtaataccaaatacaatgcctgcacatcacttcatttgtgtggattcaacatagtactcagggttcagcaaattcaagttttgttttgtgcaattttgtggattttttttccaaatatttttgacccatggttggttaaatccacagatgcagaactgatggatacatagagaggactgtatcatgaaacaggtgctattttaggtactggggataccgcaattcacaggcagagaaaaaaatctccgttcctcaaagaactaaaaatagaactaccatttgacccagcaatcatagtactgagtatatataggaaaataaagcactctaccaaaaatacacctgcactcacatgttgatcacagccctattaaactatactaaagtcatggaatcaacctaggtgctcatcaatcgtaggttggataaagaaaatgtggtacatatacactatggaatactatgcagccataaaaaaagaacaaaatcatgtcctttgcagcaacacaaatgcagctggaagccattatcctaaatgaattcatgcagaaacggaaaaccaaatactgcctgttctcacttgtaagtgggagctaaacgatgactacacacagacataaagatggcaacagtagacactgaggactccaaaagaggggatggtgaagggcaagggttgaaaaactatctactgagtactatgttcattatttggatgatgagttcaatagaagcccaaatctcagtgttatgcaatctatccacgtaacaagcctgcacatgtatgccctgaatctaaagttaaaaaataaagctctgctgtcatgaggaagggaaaggacagacactaataaaatgggcaaaatgtatgttaggcaatgatacgtactatggaaaaatgaaagcaggaaagggggaagactgtgtggaggagaggtgggtggtgggataggcatgttaatagtggcatcatcgcaggctacattaagagacctctaggtaccgactgactggagtcagggactctgccctggggtctggtggcagagtgctcaaggcacaaagaagcacagatgagaaagtcctgaagaaagggcaggactgccatgcacacagcgggaggccaggtgagtggagtggagtgagaggtggcagaaggtgaggacagtgatttggggagtgtgggggtccatttcaggaggctttacaggctgtggtaagggctgtggcatgtacttggggtgagatgggagtagaatggaggctttgatgagatacagacacattctagttcaagagaatcacgcaggttgctaagttgagaatggctcaagggcaacaagagtagaatcagagacccttggaggctcatgcaataacctagattgtagctaaaggggaggagccagggcagagcagcggtggagggagaagatagggccaagaggtttgctaacgatgatctggatgtgtggactgagaaacagtagttaagggcgactccaaggtttttgacctgatcagctggaaggactgaattcccattagctgagatgacaaggcctaaagaaggagtagactcaggatggaaattaggagttcagtttgggatgtaggaagtttgaaatgcccatgggtcatctaagcagagatgttgaatagggtagcttactatctaagactggggcttcagggtggctgcaaacatccctgtgggcatacacctgggacttagagctctgagaatgaaggaggtgacctaaggagtgagtgttggtagaagagagaaatggtccaagagccatgtccactcagcattgctccacccttagaagtttggagctaagaaaccacaaactaggcaggcttaaaacgatcaacaaagggtgtgttgtcggtcctggaagctgagtgaaaaaagtttttcaaagagaaaggagtaacgtactgtcacattgacttcttcccgtgatcttaatcccatgggacactaagtcagcaacgttaattttatctcttagtctcagttgccatagacaaaggattctgctgttcatgaatagctttatcttcccagcaagatgcaaacttcttgagagcaaggcttttgttttcttctttttctctctctctctacagcagtggcttttaaatagcttttggctacatctcacagcaagaaatacatcttactttggaaaccagtataagcacgtatacaagtgaaagacagagagaaatacttaaccttttggcatgccacacactgtctttattttcattctcttctgttgtattctatttaattaaaaataatggtgtttgtgacccattaaattgatttcactaccactaattagttgctaccattgcttagaaaagcactactgttagagtgtctgccacagtgctctgccacattcattattaatcagagagacactgttattcatcttcattccttctcaagtaccttctataaagcaagtacttaatagatgcttgccaaatgaatagttttgagaccctaaagtaatacttcttgaattgggctccttggtctttagttacctttacttttactgattgtacttctgtactgattgtagtcgtgtagaagaatatttcttaaaacctctgtgtcttcagaataaacacagacctgcatgtctttttaaagaggtccctgtgtagccaagagtcagacaaaacaccagccagggttggagatgacagcccagatgaagtgagtccatcatctgggttatcacatgtgcaaagttagggcaagaatcctgaagtttgaatgctttttcatgttcttgtacatcagcctctgggggccaggggcagtggtgttcaaaacatttttaaaaacaagacaggccaggcacagtggctcacgcctgtaatcccaacacgttgggaggctgaggcgggaggcttgcttgagcccaggtgtttgagatcagcctgggcaacagagcaagacctcatttcaacaaactatttaaatattagttgggtgtggaggcatgtgcctgtagtcctagctacttgggaggctgaggtgagaggatctcctgagcctaggagctgaaggctccagtgagttgtgatcaggccactgcactccagcctgggtgacagagcaagactctatctcaaaaaaaaaaaaaaaaaaaaaaaaggacaaaaagacaaaacaaaacctttaaaaaaaaaactttcaagaacaatcccatctttttattataatttacatagtattcaatgtcaatatgaaatattgattatttaaaaatgggagtagaaatctttcattaaatatctatgacccaaagtcgatggagctgggaaaatcattagtactaacaatgtcttagaattttgaaatgcccaactacagaaatgatatataatttaacccagacatttcatttaaagaatctttaaaataagagccaggtacatggtaaagtcctcaataaatgttagctaatgtttaaatccttctctatagagaatgcttataaaagtggcactgaagaaaataaaatatttttccaccatgtaattcttacttaggtagtttttcacttataaggaaggaggatggtgcaatgaatacagtacatcaggtcaacctgagttcaaatctgactctacttagaccagacatgtgattttggcctaattacctgaacatcttttaacttcaggttttcaaacataaagtgaggacagcaatacctacttcagagactgactataaagatagagatgatataaagtaacatatgacatgctaactcattcaaagtgtatttgtaggttgctttttcatatagtaatcatgtttaaataacggttaagttcccacatggtgcaaacccttaaagcttgtttcattcatgatagagctgacccttaatggattgtgcaatagatccaagactctctgagcttgggggtgggagggggtggagggtggggaaggttagtacacttgggggaatctctagaggcctgtgtataggggactgtggatcagtcagggttctcagaagagaacaggaaaaaaaaagatttattttagagatgactgtggtgagtagcaagtctgaaatccacagggtggtctggcaggctggaaactcaggctggagttgattctgcagtcttgagacagaatcttgtcaataaaacctcaatttttggtcataaggcctttcaactgattggttgaggcccatccacattatggagggtaatcttctttacataaagtctactgattatagattttaaccacgtgtatacaattactttactgcaacacctagattagggtttgattgggcactgggtactctaaactcagcaggtggctgcacagaactaaccatatagacaggaattcgggtgggcagcttctgaggcagtgggagggagacttgatgggcagacagggccgctgcagtgcttattgatattcagattctcttcagctgtgagctgcatatgctccgttcattttctgaggaactatggtttgggtcaaagacgtgagtgtaaagaccatctcctcactggttgttcaggagacccacaaaggccatgtaagcaaagtgagactcttactggctctgtaccagcacctagcaaggtgcctggcatgtcaatttcattgacaatgttctttaagggcaaaagagtcattcatggaatttttatttcttgttgacaaatgaacaggaaaatctacagtcacctgaaacatcccaccatggtaaataaacaggaaattggccaggcgtggtggctcacacctgtaatcccagcactttgggaggctgaggtgggcggatcacgatgtcaggagttcaagaccagcctggctaacatggtgaaaccccatctctattaaagatacaaaaaattagccgggtgtggtggcacatgcctgcaatcccagctactcgggaggctgggggcagaagaataccttgaacccgggaggcggaggttgcagggagccgagatcttgccattgcactccagcctgggaaccagggcaagactctgtctcaaaaataaataaataaacaggaaatttatagactcatcttttatttaagccctttgtattctgaaagacaaagaattccataatgcccggccttgataaaacaaatatagagctaaccttaaaaaaatcaagatttactgtagcaacttgcacatactactaatgtaacactgatcacattgttttaaaaccatttgtttatagatcagtctcacccaccaatctgtaagcaacttgagaggagggatgatgtcatttgtctggcagagaccaatattcattcctataattctagttctaagcagagtataaaagaaaacaacatattgtaaagtaaaagtgctcatgaaatctctaattacatcactcaggttgtacctattttattcaactgagaaataaagtatggacacctttcatcccagattttcctctaccaagggcagggaagaaacctcgcaatggttgtgggcaaacagggatcatggaggaacacatctccgtgcacgaagttgctggtgcatgtgtgtagagggggtatgaatgaccagtatccagaagagaggctcttttggcatccaaggagctgcagttggatgttgctgtggagatatttggggaagcaaggccacaacccccagcagggtcaactgaactctactaggcccagagagacccatcaccagatcatggcaggacgagtcaaacagaatctgaagactgtcatctcaccctgtgtattccaaagcacattttatggatcaccaatccttttttttttaatactttaagttctgtgatgcatgtgcagaacatgcaggtttgttggatcaccagtccttagaaatgttctgtgaaatgtggttccaagagggtttgggagatgctttatactgtattgttctcttaaagagtttccatccatatgagcatcttaaagattctaggatgtctgccaatatagaattctgaatacagtactcagtttctcaaattcaactccttttcttcacattaatatctattcaaatcatcctttgggaaatgtcagcttcttcacatacaaacaaagaaattgacatccagaatgtaaattacagcttatatggctaataagtggcagaactgggttagaattcagatctcctttggcccattgcactttcccagttcatcacactgcaactatttatctcaccactgaactcttcatgaatacctttcaacaaattctgtgaaactgttttgatctccctatatcaacatgtagaagacaaacatgaaggaatggctactgtgtataggagggactcagcctttggaaacttcatattttgtgtcaagcctgtgccaggatatgtttcattcaagttatcagtgcaaatgagaggtggtaatagagacatgtaagtgacatggatctatacaaataggtttgggtcacatcttgtattttacaccaagaacctagatcatgccaaccttttgatggtaaaaactgtaatgagagaagaatgcttcgtcaagataataaatgattacctttgcatatagaaataaccagaacccatgcatgcacactccattattccttctgtctcccgacattgactggaattcagtctttagtatcctctctctgtcacacacacatgaacgcacaagcacacttcatattcagtgatgatgtttttcctattacaaaaactgtgaactacccatggacagtaataatgcagatatatttcatttgagaaaggctttcttttgtcattttctttctttacctttttggtgatgagtcaagctgacctgctgggtgagatggttcagatattcatgcttcctcctagtaacgatgctggctttctgcaattcaaatgacccactacagctgcacgagtaggcacttagccacctactccagttagtaattattcgtttagactaaaaaattctgaatcaatagaaaaacattgaattaagcctcatttttgatatctcatttgacaaaggaatcatgttatttttccttgcagtggatttagataaacatccagaaaaaaaaaatgttttgtgttggaacggccacagagaaccttctttttttttttttcccaggagggaacataattctaagtcaggaaaaataatttatgtggcttcctagtttctgcccaaaccagccatatgctctcaatattactggaagaagtctgaaacagaaaatacaaagtaggggcaagaaggcccttgtgggggatgcaggggtggaaaacgggaggcagcttaggtgccccccccatcactgaggcagaggagtgagagcacctttctcctttgtacacccacttgtctgtcaactttcctccttccatttgaggctgctcctggatgtaaattttgacctgctttcagttgtaataaatacatgaggcatagaagtaagagaagctcaaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacaggcacatgccaccacgcccagttaatttttgtatttttggtagagatggggttttgccatgttgcccaggcttgtctcaaactcctgaccctcaagtgatctgcccgcctcagcctcccaaagtgctgggattacaggtgtgagccaccgcatctggactgttttgttttgatttactaaacagcttttatttttctcttctgttacacagaaacaaacaaaaagataattattttgtttgggaggcatttgggtatcatgaaatatttaaatcagagatttctagcacgtgtgatcaatgaaaatagagggaaactaggacttctgaactgatttccttttggagcattctcatagatgaatctacaaggatacaatgatttgtctgaatgataaatttacctgaataatttatctgaatgataaaattttgatacctttattaagatacttgaaggtgttggtttacaaaagattaagtaccacagtgtaaaaattctattgttgcattaatttgattagcaatgaaaaactcagaatccatttctaaagaagttgataatacaaataaaacatttacctaaagactgactatacacaaataatttctgcaatttatccaactcataaattggtatagagatttatgggccgggcgtggtggttcacacctgtgatcccagcactttgggaggccgaggcgggtggatcatgaggtcaggagatccagactatcctggctaacacggtgaaactccgtctctactaaaaatacaaaaaattagccgggtgtggtggcgggcacctgtagtcccagctactcaggaggctgaggcaggagactggcgtgaacccaggaggcggagcttgcagtgagccgagatcgcgccactgcactccagcctgggagatagagcaagactctgtctcaaaaaaaaaaaaaaaaaaaaaaaaagatttatgtaatagatgattaatcatagcactggttgtaaaagcaaaatgcatggtagtgaatactgttccccaatatgtattgctaatatactagttctttaacatgtgatgttaatatagtacaaagtagcttcattaaagaaagagttttgatttgattcaatcctgtgttcccggtgtctggaagtgagcttggcacacagtagatgagcattaaacatttgccaaatgaatggacactccatataatcaaatatatgtacataggtgaatgtgtacgtacacatatacatatttgtatgtttgactatatgtagaaaatagcagaaggcgaatgttaaaatggtaacagtgatggctgcctttggttaaataagactggaacacggtgggggagggagcttttacttttaaccctgtatcaatctgtactatttgaatttttttcacaattagcatatgtaacttttattaaaaaatgaattctgtgaaagaaccccaaatgtacgaccactggagatctgcattttagaatttgtgttgtctttacattatctcaccttaaagatacaactccattatgtacacgataacctaaggaacaggctttgactggaaattgatgaaacttggaccacagaatcagaaattagaatcttcaaagaatcgtcattacagattatattttgcttttccatttcttcagcttcaaccagaattttatattcaaagttaagaaaatttacatgtaactgtatgcaaaaacccatatggcctgtgtcagtctgtaccacttattttcaatgagataaaatagcttatttaaactttgaattttcccattgggtttagatgatttagctgtttatccagcagccctatacttaaaaatagatgagatgacatttgtgggttctttaaaaaaataccctttggagaaagaagcagaacactaatgccatatttaccatttacattatataagaatggcaagtttttatagaatgagtgcttcatagaaaatatcctcctttctggccaggcgtggtggctcacgcctgtaatcccagcactttgggaggctgagggggcagatcatgaagtcaggagatcaagaccatcctgggtaacacggtgaaaccctgtctctactaaaaacacaaaaaattagctgggcgtggtggcgcgcgactgtagttccagctacttgggaggctgaggcaggagaatcgcttgaatctgggaagtggaagttgcggtgagccaagatcgcgtcattgcactccagtgtggcaacagagcaaggctccgtctcaaaaaaaaaaaaaaaaagaaaatatcctcctttctaacataaaagctatagctcttctgtaaccagtcacaatcattgcatatatgagggcatcccacataagtttcattatttgatgattataattaatttaatggaaacataaacatggttggaaagtttccaataatagcataggaagatttttctctcccttctcccttccaattatgtagtgcctccccgccatcgccatcattcttttatcaattatttattgtgtgtctgctatgtgggaggcacagttgttataaaacaaatataaagttgatgttgactatatttaacttgaccttatatacctatttaataattatagcaacctgccaaaaatgagaagtgattaatattagccctaaacctgctgtcatacgattccacagagttcaagataagaattaacataagttaagctgaaaatatactgtcacctgaaattgcaaactgggtaggtatacaggagaacgatagtcaattaaagtatgaaatattcaaatcagtgttccaatcttggtagcattgctgatggcaaaggatgatgacaccaggaggaaatgaaagcaaacacatcactttcctactcagaatagtacacctatcttaggatcttactgattttatttattaaaaaaatacactttaggagaaaagtgcatttatcgggtaatatgaaagaggaaatgaggtctgtgtgagggcatgggtatatgccatcactatgcaacattttaatcttcagtttttataggagtttcctctgagcactcatcaaaggtaatgggattagattttttttcttcctttgtcaaatgttttcctcaccctgaatactgtcacacacgtcgcaggtggatgagatttgtccactgaggaggaattgcacttttcgaccctcctaggatgtgacttgaatacctggcttgttccatgttgggcttgccacctgctcctgctctgaggtagccgctgacctaaaggcatcgcaagggtggtgaggtgaagagggagcaagtgttctcagccacacatttttccatctcccctcagaatccacctctcagaggtagcctaagtggccctcctaccggatgcgttgttttatcacgactgcagctttcttttcttagattctgccaatgcttttaatgggctggtcccctgcgaagagcagggattttgtgttttcttttgaagagcgtggtagatttctgagcaccctgtggcagtctgtaaaagtgataaatacaaatgatgaacaatgaagcaggctcttgagttctggggctggctacaggagaactcagaacgagggaaaaaaataaatcaatttctaacacaaaggcaagatttagcctctcattagatccaactgctacatgtaaagaagtttgttaagaaaatggcacagggattttgtgaggtggagccaagcctgcgaaataggctttcaagatgtgttttctatcttccttccaattttgggtgctatgatgtaacaggattttgaaatccaagcatatgttattttctttcttcttttccttttatgtttaaacctccattatgatgaattagctttccttcctcaataatttagagtttattttctataaaaaggaagcatttagaaatgtgatattaggcatatggccccctttcagatccttccagttctatttgtatatggttttagactcagctgtaaatatattaatttatgcagcaatggatattataaatcctacactttatatagatgtaggctctttcttttcataaacaaaacttgaaacaatactaaatttttaaaaagatagacataattgataatttcactttgagaaagcaaagtaacccagattgtaaatgttatggacaaaggctgggcgcagtggctcatgcctgtaattctagcacttcgggaggccgaggttggtagattgcctgagctcgggagtttgagaccagcctgggcaacatggtgaaaccccgtctctactaaaaatacaaaaaaaattagctgggcgtggtggtgtgtgcctgtaaagccagctatttggggggctaaggcacgagaattgcttgaacctgggagacggaggttgcagtgagccaagatcaagccactgcactccagcctgggcgacagagtgagattctgtcaaaaaaaaaaaaaaaaaaaaaaaaaaaaaaaagtcagggacaaggataaatgcaaattgtacacatttctctctcttgattttatgatagtttggaaaagaaccattttttaaaaaccagtatattactaatggatggcatctaatgtcttagtaattaaaaaaaatatagattgggatggagccacagaattcaacaatggggagaagagagaaatagaaggcagagacaattttagaataatagtcaactgtctgtggaaaaaggggagcttcagttagtgaatgaaagaattgagttttcctgatgttttcatctaagattaccctcataccacatgcacagggcttgatcataaagtatttgaagttagtaaaaatgtaactagtccagttgagctaaggaaatatcaaaatgtcaattgttctttcccaagtttagtcaagctaatcagattctttcagttgttaagaaatattctgttgtatggtttatgtgtaaatatgactagaaattctcagcagtggtaaagcatcgtaactgggcatggttgctacacatatttgtatctctgatagtgcctggcattgtcccttgcatacacaaaaagttcaaaactacatgcttaaaagtgaaggatttcactctcccctgaaagcactctatttgatagagagcagcactcttttgtgcttacagcaatgagtaaactcttagagccaggttgtgaactgcttgttgtggatatatgctgtagacatttaatcacttgataactcattagtgatatatttaattcatctaagatgatttatgtttcaaatgtgaacatgatgctttaccattacttttactatttaataaaaagataattgttgcatccatttataaattttgcattaaacatgacacatttatcttttcaaagaaaataattgttaatcttagaaaattttcctcaaatgtgcaatacaccaggcaaaaaccaaactctggttttactgtacttgaaaataaattagcatgcatttcacatggtattttgttattctcctttcatagcctgctttggttaaaaaaaaatcatgtcataaaagagatggcaaattagatctgggagtgaagaaaacttgttcctaaattttatcttagatattgaactactaaatagatgataatgaaattaatgtctatttcatgcatgaagcagctctattacgtgcttttataatttcttgcttttgagaggttaaggtggaagggcttattttctttagacactgatcctgggattcatgaacttcattattctctttatcttatgataactatgcccacagggtacaattaatgaattaattcatcaatccactcattcacatttatcgaatgcttcctgtgtgccaagcactgtgcgagtagaaaccacaagaatcaataaaatcaatagacttatatttgtctctagggggtctactgtctattgggggacaggtagaattattggaggggagggagcaacaagccctcaaacttggtgtcagcaaagtgtgaaaatcactagaaaatccacacgtaggcattggtagcatgggagctagtttaaggaggttatacttgtcttgggacttgagtgatgggaaagactttggcaactgggcaaagagaagagaggagggcagtacagaagtgggaacagaaacatgagcacataaacaggcactatatatactcatgggaagcagcaagcttcacttcggacctagggcctctcagggtactgctagaaacagattctgttgaaggtattcagcttgtgctaatagtctgtacttgttttaaagacccaggaggtctttttcagaatgtattttcttgaacagcctctttctatcaccaacatggcactgagaacaatagaaaacagctccttttgtttctgggacacacctcctcttttctaagattcatgcctggttgcccagggaaattcctcaaaccagcctttattctgagctgatcactctcttctgaacaggacattccgccatctgctcagacaccctggctgtcagccccaccctgaatcaccaggcatcacctcccttctcaaggagacctcacttctctttatgtctaaagccccacaaatggctttactccttcaaaaccctctctttctagacttcctctagcgccagcgttgcaattcctctgaccacgtatttaggcacacatataatatttagagggcctctctactccacatttaaccctgtaatatcatcttttttatattaacatcttattcctctttatcagctcatttggagccatgtttcatttcccaaaatatcaccactatattcttttggctgttgcatcaaattaccataaacccagtggcttaaaaaatctcatatttaatctcttacagttgtggaggccagaagtccaaaatagtttcactgagctgaaaccaagatagcagagctgggcgtcctctggaggctcgaggggagaatccatttccctgccttttccccttgtcccatggtccctttctccatcttcacaaccaagagcaaagcatcttcaaatctctctccgcttccacggccacatagtctccctctgcttccttcttaaaagaacacttgtgattacatttagagcccacccagataatccaagacaatctcccaccttaagatccttaatgtaatcacatctgcaaagtcatcttttccacataaggtaacatcctcagtttcctgagattagagtgtggccccatctggagcctctattccactaactacgaccacccacactaacaccattgttaatcgagtacttactctgtgccaggcattattttatgataggcaccatcattatctccattttacagatgaagcagttgaggcacagaaagctttagtaatttagtaaagtcatatagacagagaagtggtagaaagagcattcaaatctaggtctgttcaactggaaagctgtcactcattcacggaacaccctgttgcctctcacattttccagctgactgtgtgcgtctgtgttctggtttgaattaaaggaacctaaaaactctcatggtcaacacaaaatggaaaatttcccagaaactgcacatgtctcttctctagctgtacttgtagatatttcttccacaaagagcatagctaattaactggttaagtggtaacaagtagcagtttgcttccccagtgaaataccagtggaagcccccctaagtagtctgacatcaggctacggttgaagaacatgaagggccaactgagttcaggcaaagtgctatggaaacagtaatcacagagcaggtccaggaaaataatgcctgtttaaaaggacaatggaaatgaaacagaaatgtaaggcccagctactttctctgtagagaaagtgagaaaggctgaaaactcctgtagacataaggcttgaagaagaaagcttgagaataaagaatacagcacaaagggaagtactttcagtttaatttaagggaaaaatacactcagggctgactattggagatcagaaggcaaatgaacactggcaggcagtgagaaattaaggatttaaaaaatgatccttatacatttttaagaataaactttttcttttattctaaggaggcagtaaatcacgtggaaaatagaaagaactggtccctggagtcaaacagactgagggtcccattccttaatatcagcatcatacatgacaacttgagcctcagttctttcatttacaaaatgggaacaacaacacgaagattaaggaaattatatgaaccaccttagcacagtactttgcaggaatgagtagcataaaaaatcattgcatctggtttctgcaacctcagcaagacaaaaggtaatacagcttgttaaagagtccagctagctactagtgcattcagagagaattcactctgtgccaggcatggtgctggatcacgggccacaactatgaataagagaccagctatgttctttcatgaaacgatctagtggaagagtcaaacaagaaaacaggcaatcctacctaagatagaagaagcatgataaggaaatgatgggtgctatgagagcatattgggagaggatacctcacttaaacttggccagtcagagaaggcttccaggaggaaacattatcttagatgagactggaaagttgggaagaggttaagtagggaagagaggagtttggcaggggtggggggtgaggggtggagggggttgtaggcaggcagaagagacaaaggaggaagcagctcatgcaaaggtcctgggcaagagaacatggcactgctaagaaagagaaaagcagaccagtatggctgaaatgcagagtggacagagggagtgttaggaaatgagattgtgaaggaaaaaggtccccagctacatcatactctctaagtcatgtttaaaagtttggactttatcccaagggtaaagaggaaccagtgaaggatttttaagcagaagatttaatgattttatctgtattttagaaagatcatttgggctataatgtgcaggatgaactggatttaggagaaactagaggcaggaagaccactaggagatatttacaatagtctagctgagaaatgatggaggtttaactgggatcgtggcaaaaggaatggcgagaagtggacagaaataagatttggtgtttttttttttttccactcattcattcattcaactaacttttatgagtctgccttagaggagagacacgagggtgagatagagagaggtatcaagattggccccatgtttcagcgttaaaaaaaagcatagatagtggtgccatttacaggggtaggaaacatggggtagcaggctcttgggaagatactgagtgcagtttttgacatgataggtttttgtgtcatgcctttatttttgtaacctcgatatctttgtgtaccccaacctgtgagaatagatgaggtcatattaacagtaataaccaagtccagtgatactttagttctctctcatctttgttcctcgcccagttaattctgattgtccacaaggatgagcttcacgtgtatttgggaacaaatctgtttgctgccttctgtcaggcctttttgcaatggtgccaagaacttcttatgactgtgggccatctgtactgatgctgctgcctcagtcaccactgtcctcagctggtacctgctctgtggcctttgatgtgtgtgtgtatatagggaaggtgggggtgcttctttctctagatattctctattaattaactaacacagagctaatatgtgagtttgtaaataacacatgccttgcatttggcattgctaaaaataccttcaagggctaacaactttgcatcttatctcccagcatgcatgggttgaccactacagacaaaagatcatgaagctgatgctggccaaagagccttgcacattttcaccctcaagttggttttatgtagcaattgcggataaaaagctctgctggtataaaaatcttcttattgtacaaatggcaggaaatagaagacaacattgcggtggttacaaaaatttgtttcctagtttgtttctgccagctttaaattgaacatagatcaatctataggttctgaattagtaatattggggagacatgaaatgagaaaaatagcagaattaaataagcataacagtgcacggggcagcccagcatgctctggagcgatgaggggtgagagagaaaggaagaaaagaagaaaacaaaatgaacacctttcaaatccaaaacaatgcaccacgtttgagcctccaatatagttttacaaagacagaatagccatgaaatcaaacatttaagtataaataggtaacatatgtctgtcttattgttgttaaaaattaactgtgatagactgaaattccattccacattcctacttcttgatgacttagtaaattacaggcatttcaagagaaatgcctaaaaattttaggtgaaccatcgacgatattttgggtggaagtaagttatatgtggtagctaaatacttgtgctcaagctctcagcatcctgtttatacttctaggaaagacatatgaaatgtgaacaatttcaaggaatgaaataaatgttcttctttatctataaaagtctgattgtggtgtttaaaggcttccatgaaacaaaaacacctgtgcccacagctcgtctcccgtgcataaaaacagaatacaaagatgagacagtaggaataggaggaacattttctatttctccaatatttcccacatgctttggctgtttttgaatagaccttctgaaatatcttttgaggtcacctactttgtgaacctaaagtctctgatttttcaggtgacatggcagcaagcccgaatgtctgaaaacataaatcttagttataatttccatttttgtcattttgctagaaaagaaaaatatgataatttcttccccagcttgctaagcctttgctagtttcaggaatttctgctaccatctgatgaaaatcaaaatccccgtattaaacaccaaaaagctatatcacaaaaaagtgaagccatcctagtaagtgcctcatcacttcttgtttttgagatagagtaaccaaggtagcaatagaagtctcagagagagctgatggtttctaattccataaacttagtggacaagtacattttccacatgaaccaaaatcattgccgccatggtgaatcaaaaaagtaataacaaaaattcacattaccagcacgctgttattttaaaaatccaattttacaaaataaaactcacctaaactgaagctgtggaataattttagcaattgaaaattactaccttctctagaataacatgtacttagaaatgaaatgattcagaaatcaacatgatgtacgtattctgcttttctttgcagcttagagcaaattcaacatcaatttacactatatcatagtaaatatattcaacaatcagtgcttaagtaatttagcctgtctttgctgcatctaaatattctgctgtttaactaaattcactccatactatagatgataaaaatattaatatacacatttcattcttattaaaaagctggatttctcccttagccctgcaagtaccataagcaaccaaatcagaggaaaagggtatgttggggctactctttataaaattgttcatccccagttcacagacatcatgaaacatgaaattaactccagtatgttaaaagaaagatgatagattagcacagaaatcaagcacaaagaaacgatttattttcctttccatagcccagaattgctattagcttaccttattagctggaatgccaaacagaatgtctttatggaaaattaagttcattattcatctcagctttgatttggtatagtgcagctgagagcatttagcttctctctatgatttgccgattctaagtggttgagtgaggcagtaaacacaggacttgggggtggggggagagtggttggtcatggctcacaactcaagatttgcaactttacattttcattcatataaagatacttaatgaaataaaaccctatagctgaagaataacacttaagtgaatacttagtgcagatttttcagcctgtgcaattttgcatagcagttgtacttacagagtctggcatgctcactgtcccagcaaaatcatattgctatctttcattatctcagtaaattctgggctattgatcactttgcagcccatatagggggtaacgtatattctgtcaaatggaagtccccatcagggaacgatccttgcagcttgctaaaagaagcatgcctgattgtctgactagtgatggaaagacagatgccttttacaatgttgaagtgtgcacatgcacaaattggatagaacattcagtcagctaacaaacagagagattttaaggagtaaaataacaatagatttccatccttgagatatcaaattctcttttagagaaaaattaagtaatacttctcaacaattcattcattttcttcaaaagaattaaacgtgttgtagaaacctcttggcaaacacttttcattttttaaaaaattgacttccatagagaaacatcccagaaaatcttattgaaagtgtggtgtgtgtgtgtgtgtgtgtgtgtgtgtgtgtgtgtgtctcatttcgggatggggcaaaggaactgttgcagcgtcctcttccaagtatttcactttataagttttaagtgggcagcatttactaaaatccagctttactgagtgcaatctgcaaccacatcagcaagatcacttttaggttatcaatagacaaggacaatacaatttcagtagagcaaagacttacacctttcctttcttcgtcaccatacaaaaccaaaccctaaaactttcctctactgaattaataaaagcacaggtgcatttaataagaaatgataaggaaaattataattaaatgattggtttgtttcaaagtgttaagtatagtgtcaccatatgacccagcaatcacgcttttaggcatataccaggagaaatgaaagcaaatgtccacacaaacacttgtacacaaatgttcacagcaccattattcacaatagtcaaaaagtggaaacaacccttgtatccactaactgatgaaaggattaaaagtgtagtatatccatacaataaaacattatttggaatgaaaagaaatgaaatattgatacctgctataacatggataaatcttaaaaatagtatgataattgaaagaggccagtctcaaaagatcacatattacaatattctatttatatgaaatgtccagaaaaggcagaatctatagggacagaaaagtagactagtggttgccctggacctggggtagggggaccaggaagtgattgctaacaggtacaggattccttattggagtgaagaaaatatttttatcttagatcttggtgatggttgcacaattgtgaacacattaaacccattaaattgtctactttaaatgggtaaataatatcacaataaaatttattttaacatgatgcattacattgatttgtgaatgttaaattaactttacatccctaagataacatttgcttgctcatgatatatgatcttttaaatatattgatgtattcaatttgttaaagggcttgcatgtctattttataaggaagctaggtcagtaaatttcttttcttgtaatatctttttcttgttttggtatcaggatagcattggcctaagaaaataaatcctgtttctgaaaaaaagagatgttataaaattattaatttgccaaaagaacgttgtcatatgtttataattatatgaatgagttttatataacacattctacacaaggcagatagggagaggttggggaagagaaaggatgaccccaaatgtgggatgctcttgaagactagaaggctgcagacgtatctcaagaaccacctgtgccggtgttttatcatggctaattttcagcaagaaaacaaatctccaaatctgcaagagtaagagcaccaggaaaaagaggaggactaggaagaagaggaagaagagaataaagatgaaggggaggaataaaagaaggaggaagaggaagacagaggagaataagatgagggggagagctgtgtttgatcaagagcatgaaagggcaggcaattcaggggaaggtaggatcaccaaacgtaattatagcaacatcctaccaaatgatccagacgagaataaaggaagcctagaaagaaaccaaaagaattgcacaatgagggttttgaagtattccaatgaaagaaacctgttttaaacatgagagatgggttcacaatcaagaaagaacacaggtaagtgataagtgcctacacaaagtgccccaaaagggctaaagcccagaatgaaatgaggtttgtgaattttaaaaagagacaagggccaggcacggtgtctcacttctgtaatcccaacattttgggaagctgagatgtttgagacctccctgggcaacagagtgggaccctgtctctacagaaaataaaaaaattaaccaggtaaaattagcatgcaagtagtcccagctgattaggaagctgaggtgggaggatcctttgagctcaggtgtttgaagctgcagtgagtcatgatcgtgccattgcactccagcctggatgatggagcaaggccccgtctcaaaaaaaaaaaaaaaaaaaaaaaaaaaaaaagccaaggacagtaaacacaaaaaagactttttaaaagagatggcttagaatgaatagaatgaggaaaatcccaaggcttgttccagatggtacaatgtgaacagatgataatgaaagaggaggaagaggaggaggagcagtagggaggagggaggagaaggacaaatatcaaactctcacacttttatttttctactattttctctatcagaggacatgatcttcaaattttaaaagggagaagacgcatggtaaagagaaatttgaactccagcaaaacctcttctatgcagatgactcatgcatttatatttttgttccagaactcccatgtgagagtcaggtacctgccaacttcacttagatacttcaaagtgctgcatacatagcaccttcaaaaccaaactctcccgcccccatctccaccccagcagtaaaagtactgggctcctgtagagttctgtacttcagtgaatggaacaactgtcttctacgcaggtcagaaacctgggtactctttttggacacttccctctcctgccatatcaccaagagatattgatttggaatctccggaaaccacccacttaccccaatatcactgtcaccatcctagtcccagtaaccattttcttgcacctggatattacatttgtcttctaaccgattctcctcttccactgtccttctccttccactccatccaaaaggatgttttcagagggcaaagtagatattagctttctttgctcctccccccaacactagcaaggatataaagattcaaatgttaaacgtgacctctggggccctgtgacatggtcctgcatctttccagacttatctagcactatcttggtgatccagccgtgctggattcatttctcacccttttgtttctttctgcctttgcaaacgctcttccctctactggaggcatgattcccttggctcattgtctgattaagtctagattttcttcagacctcatcccagtcttacttcatagggcatgctttgctgaacatctcaagtcaatatgcgattatctaatctcttctgtaggtattgagccaagtgatcatttgggatcaactttacttatgagcagaaggctcaaaaggtgcatgggtcactacactcttagtatcttcaaagagactcacctaaggttgagtctctttgttaaattcactgtggagagaactgactctctgctagccacccttctaataggatgagtatgaggggtgcattgcatggagggaggcaggaaataaacactttgagatcaaggacactacagaagatctcaggtactagatgcataggggagtgctaagaaataccaattccgcatgccctagactccatagggccctagtccagtggaaagttgaattctgctatcatttctcccaatgaagaaagggacagccctgattgcagacatttcactgccagagaaccagggcagagctcccagaatagttcaacagcagcccttaccatggtagtaaactgacattcatttgtgtgattgatttgagaatgtttatctcaccactgaacaatgggagcgcaagagcagcaatcatatatgtttctgatcatcttgttatcctttgcctctactcggggcctagtgatagtaggcatttaataaatatttttgaatgaatgaatgacagagctcttaaattgctaggctgtgctgagagggtaatgacagcattaactgcgattagcaaaacacttgaaaccaagtgttttatatagagtgttagtactagtggtcttgtttataaatctgacctttctatatctttctctggccaataacactgtgatgccattaaggcatgaagattcaatattagtcaaacacatacattctgcttagaaaattagcatgtgggatgttgaggccaggtgcagtggctcacgtctgtaatcccagcactttgggaggctgaggtgggcggatcacttcaagtcaggagttcaagagcagcctggccaacgtggtgaaactaacaagacaaaaattaaaatacaaaaatctctactaaaaatacaaaaattagccaggcattgtggtggctgcttgtaatcccagctactcgggaggctgaggcaggagaatcacttgaacctagtgaggcagaggttgcagtgagctgagattgtgtcactgcactctagtctgggtgacagagcaagactccatctcaaaaaaaaaattagcatgtgggatgtcgatttaaaatattataagatccattagatgaatgatttaattttcccaatgaagacatttttctttttaaaaagaggacacacctaaaaatattaagctcgaatttttgtgcttgacaaattataacacaaagaacttttggtagggcccccaaaatcaacctgggcattcttaaagattgttaaaagaaacggtggtggcaaaacactgaagatagacaagacttttgaagctttaaagaaatatgttctgtatatagtagcatgataggcttgactttatacctcagcatcatcctagaacaggctgttaaatggaaggtccgtgagtgcttaaagaagcaacccacatttacaaagaagtagtatgctaagctgactgtgctttatttttattttttatttttgaagattaacttggttgataggtaaacacacacactgagatttcttataaaaaatcatctttatagaaaaaaaacaggagaaaaagatttctaaatggtaacaggactggttttcacaggagctgaattttctcacttctcctggaatctattccaaacaacaaaacaacaatacaacaaaatgaaaagaaacacccacaaattacattttcagcaaaaccagcagaaaatccacagactccaaagtcagagtcaggcagaaagccaaggagaaaagtcttaatactgtggtaggtaagtgggaggtatgaaggggttctagatatagcagaactcagaaatctctgttgaatatccactccccaaaagtaagggccttaatccaagaggaaagtgctgcagaaaagactgaaatttacgcagcaggtggagggtaaatggcaaatctcattagggccaggaaaattctaaaagtgttactgaaagtgacggcatcatttgtgttcccatgtgacaggcagcctgtgaagtgatccatgaagtaattgaggaagaacagaactaggtttggttctgagtcagatgatgtgtgactatatagatggatcatattatgaagaaacaattgtagcagcagcaaaggaagcctttgatgcttggaaaactactgcccatcattccctctacaggaacattcttttgatttcctaggaaaattcaactcattcaaataggagtaatatacaagtaatacacatacagatatgataagaaatatggcctatgacatgaatttacctatataacaaacctgcacaatatcctgaacctaaaataaaagtttaaaagtaaaaaaataaaagaaacatgaagaagaccagtcaggaatttcttgtaaataatgaaaactcaactgaaatatatgttgtcacaaaaaagattaaaagcataacccaacattgttattaattaaaccaataattaatgaagcagttatagctataaaagaagatcacaaagcagagttgtaagaactcagggaagaaatgagaagaaaacaggaggttactggtacactgctggaggatgtcaaatgggaactggcggaattgaaggaaaggaaggtaaaggaagggacataaaagataaaaagtgaaaatgcaagtaaattatacagaggcaaaaaagataaagaaggattagagagaaaaggacatgtatcgaatatggcaaaggagagccatcatatgcatagctgtgatctcagaagaagaaagccaaaacaatggaatagaataattactttaaaatataattcaataaaacttttctaaaataaaaaagccttaaatctacttatgaaaaagatatccattgtatcagtgcaaagtcgtctagaatgatcaacccaaagacacatcccagaaaaatttttgaaaagaatccttaaggcagtcaaggaaaaagataaaaatcagttaaggaagagaaaatgaagttgacatcagatttatccacagaaatatctaacctcagcaaagagtggagcaggatccataagataccaagttagaaggcaggagtcaaagattttctctctaataacgctccccttcagtatcaagactcaaggaaaaaggcagctttgagcctgccaggatttgggtaacactgtttcctcatgttttctaggggaagatcctaaaggaggtgctatagactaacatgaatcaacagagaaatgtcggcaaaagaacctgtggccagtgtttaaatgatccaacatgacaggaagttcctgttggctacatatatataccctttaagaatttttttctattcccaatttgttataataatttttttgttagatcattaatggctgttgaatatttggaaataccttttctgcatatattgagacaatcctatgtgctttttatcctttaatctttaagcactgagagttatgtgaatatcttttccaaagttaacctttctttttgttaataaataattgtcatctggccatgttattttacattatttttaattatttaattgtatttttaagtttattaagaatttttatgtcagattcatgaaagaaattgcatttaaatttttctttcttaaatggcccttgtctggtttaagtctatattaaatcctgaaactagttgggcatttattttttgttgttgttgttgttctaatttctagaagaatttttatacgacagggattacctcttcttgcaggttttataaaaattaatagggtctggtctttttctgagtaaattttaaactaaaattttaaattttaatatgtcagtttcttaagttgttatggatatattcaaggtttctgtttttactgagttttgaatgctttatttttccaggaaactgaacacttacattttcaaggtacaggttgagtattccttatctgaaatgcttggaaccagaaaggttttgaatttcagattttttcggattttagaacacggtcatgggccaaacgacattttggtcaataatgattggatgtaagacagtagccccataagattataataccatatttgtatcttttctatgtttaggcacacaaatacttatcattgtgttataattgcctacagtattcagcacagtaacaggcggtaagattctgtgatctaggagcaataggctatatcatagctgaggggtgtaggaggctctactatctaggatgtgtcagtaaactctatgatgttcacacaacaaccaagttaccttacagtgcgtttctctgaaggtattcccgtcattaagtgatgcctggttgtgtttccatcttactggttcagcaaccccaatccaaaaatctgaaattcaaaatgctccaatgagcatttcctttgagtgtcatgttggctctcaaaatgttttggattttggagcatttaggatttgagattttcaaattaggcacactcaacctgcactcgtatgaagtttgtttctgtttttgctcatatgatagatttaatatctactgcatatatatccacggcccttttttcatttctgttagtgtttatattgtgctttctttttttccctccttggtgactttactcagaggtttattaatattatcagtctttccaaagaacaacaacaacacaaacttgctaacagtgattatgtctgggggatttctattatcttctttatgttcttaggtattttacaaaatgtacccaataaatgcatattaagtttatgaacccctccccctaataacacctgtaacaaagtaatatgcttttaaataaaattttaaaatgtagactggataggagattcataactggttgaatgacttttcctaaatggtatctaaataatttcatgaaaaagaacaggacagtctctagcgagaagcagagtctttctttctagccctattctgaacttttaaaaattgccaacttcaacaatgagatattggatacaattatgagtattaaaatatcatacatacattggtgggggaaatatttaaaatattggatctcagatttagcattccccaattttgttattgttttgaaaacattctttttggtaattcaaatgacacttttagatgagcgatttagaaacaagttgttctttcctcaagattctactgccattttctggaaaattatagtaataaacgaataactgtaagatgactactaacgtaagtggagctccctagagttaggtagtgcacaagctgcacatcagtaaccagtggcccttgcctagaatacactcatatctatataataatatttaatacagatacatgtaattgtaatactctacattgtgttaaaccacctgagtgtgcagtacagtgtggggaaacctatcagtatgatttcgtgtgaaaaaatggtcctagaaattttacctgagtgtgaggcagcctgacatgattaccagacaagctggtactttgatagaagttcatggccaaagagttccactgaatgctgtgaagtctggacccaaatgaaataataatattcacgctatgacaccataagctaagagggatgcttttcttgggatgagatacaatttgtcagatgagatgctcaaagtcctgttcttaaagaattgctgaaggcaatattcacaatagcaaagtcatggaatcaacctaaatgcccatgaacgacagactggataaagaaaatgcagtacatatacaccacggaatactacgcagccataaaaaagaatgaacttatatcctttgcagcaacatggatggaactagaggccattattctaagtgaactaacacaggaacagaaagccaaatactgcatattctcacttaagccaaacattaagtacatatggacacaaacaagggaacaacagactctggggcctacttgagggtggagggagggaggaaggtgaagatcaaaaagctgcctatcgggtgttacgcttattacctgagtgacaaaataatctgtacaccaaatccccttggcaggcaatttgcctatgtaataaacctgcacatgtaccccttacctaaaataaaagtaaaaaaaaagctgaaggaattagttctatcgatggtggaaaaatgaagacttaagtggcaaataatggtttgcattaaacatttgaaggaatgccatgtggaggagtaattaggtatatttcctgttgttttacaatcaacaaaagggaggtagattttaaaaaattaattaattaattaatttatttattttgagacggagtctcactctgtcatccaggctggagtgtaatggcatggtctcggctcactgcaacctccacctccccggtacaagcaattctcccacctcagcctgccaagtagctgggactacagacgcgtgccaccacaccaggctaatttttgtatttttagtagagacggggttcactatgttggccaggctggtctggaactcctgacctcgtgatccgcctgcctcggcctctcaaagtgctgggattacaggcgtgagccaccacgcctggccaaaaaatttattcttattttatggctccaagacaaattcaaagagaagtggatttggattcacaatacagaagaatcgtctacaaagcatgtcaagaatggaaagtgccattggggtgggaatccaggccacttttctagagatcactggtaatatgtgcaaggagtcaatctatgtgtaatatttagtgttttgcatgactgttggcctggctcatctacttccaggaatttttcctgaataaacaactagatgattattgaagagtttgtaacagtaagggatttgaataggttactaagtaaatacaaagaaaagaaaaagaaatgtgaaagaaacattaacgagagcaaagagagctgggaaagagaatgaactcaacggaacagaaactacaattataagcactggggtaaaaaagagtgtgagacattattagaaaatggccagtcaaaataaggttgaatgcaagacactgaggcaatggcccaatttttttgttaattagatgagagaattgtgattgctaaaattaaacttagattgaggaactctggtgaagtgaggtcaacagaaatagctaataggtgggaaattaccttagtcacttgaaacagaagaaacctattactaatgggtattaaattatttataatataaagaaatacaggccagacgcggtggctcatgcctgtaatcccagcactttgggaggccgaagcgggcagatcacgaggtcaggagatcgagaccatcctggctaacacagtgaaaccccgtctctactaaaaatacaaaaaattagccgggtgtggtggcaggcagctgtagtcccagctactcgggaggctgaggcaggataatggcgtgaacctgggaggcagatcttgcagtgagccgagattccgccaccgcactccagcctgggcgacagagcaagactccgtccccctccaaaaaaaaaaagaaacacagctgattatttagtgtcatgctacatccatagaggacttcagtatatagtatgaagaaagtgcttgctctatgtattaaattatttataatataaagaaatacagctgattatttagtataatgctacatccatagaggacttcagtatgtagtatgaagaagatgcttgctctgtaagtgtgcactctaggctagatattgacccagacatttgtgatgtctccatctgaaaataacaaaaagagccgaaaacctctgtagattattatttaaaattagaatatttaaattattttaagatgctaagaattacttgcattactttcttcaaattgaaggatgtgcataatatttgggaattctaaccaggaaaagagttttagcctttcattgaaaatgacatttatggtattattcaaaatggtaaaaagctgtttaaaaattcaaatgacaatgaatagaaatagaaatgaatattctagccatggtgtatttacatactataataacaatacatattttcattaaatgatagagtattattgaaaataataaacatttatcaaaatgacacaaaatgatttttaccctaccagtttaaggaaactcttggcatgtgcagtagttacttcccaattgccaagttcacgatcaagctttccattccttgtctgactggaccactccttggtagttgactttgttaaactttccctgtttcttgaaatcctcttcgtctccctttactcccacacttttctggcctatttttatgacctttcttagtgcttttcctatgattcctgctgtgtagcccaggaagttggcttgtgatgtctcatcttctgactttacacatgccccagtgtgacctcattcactctcaaactcctctcagcctcctatgtgataactccccagtgcctttctccagttctgatgtcttccagaactgcacaatcataaatccagctgccttcattcctccctcttcctcatccaccccactcaattcttgaccaacttgatactctcaagatacagtagaaaggtgtgtttacttctctccatctttattgcttcaatcctattccaaacacaatcatttcttatctggtttactataataacttcccaaatagtatctgaataaatgaacatttgcctacgggatatcttcaactgaataggcttcaggcatataagattcagcaggccgagaacaaaaccaacttctccatctaaatgtattctttctcctacattaattatctcagttggaagtattgacaggcacccaatttttcaaactataaatttttcatcatttttacttttctctttccagacacctcagtagttcaatcactaagtccaggtgattctatacttaaaacatgttttttcctatttaaaaaactttaaccatcagttcccctctcctcccaggttggtgagagctctttgagggcaagagtcatgtcctttcaactttgtattcccagcctttaacagagcccttaatctgaaatatacttagtgctcacaagtgtctgaattaaaaattatatcatatacaacaaaagggaaacatatatatatatacgtgtatatatacatatatatacacgtatatatatatgcacacacacacacacacatatatatatataaaacacctgattgcaaatgtgcaagatgtatgcatttacatgtatagatactggaaggggatttcaaatgacatgaataattggtgttttactataaagttaagagactgataaaaatttcaaataagaagcagcaaatatgttactcataggcaaaggggaatctagatctaataaactaaaaaattgtctggcatgagattcttctgctctaaaaagcttactaaatgagctttcacatgataaacattagagggcataccatctcacaagaaaggaacactccttttagatgacactaagagttaacactttaaatgtaagaagaaaagtggtggatgaagctattgaatgcttatgtttcaagaagagtgaacaatagaactttcatgcttcagagctttttccatacatgaggttataagtatattttaagtgagatgttagagcaggtgacaatttttaacagggactaaaaaattaattgcaactcaaaaattaacaatatttaagagtgaatgactgtatactgcagagtatgtaagtaagtacaccatctacaagtgctctgatttcaaatagtgatttgaatggacatgctgcctaactattttagaagagtattcttttaaaataatctaaaaaacacagaaatggatggtattttcatttcatcaccatatacgtgaaatatccagggaccagtgcatatatacaatgatctcatttagctgataggcaatagatatataatttcacacatctttcacaccaagtttaaaaaaatggtattaagtttaagaaatagcttatgttttagatagtagattctgtagtaggcagattacggactccccaaagacgcccatgtcttaatccatggaacctgtgaatgttaccttatatagcagaagggacttcacagatgtgagtaatttactggtcttgagatggggagattgtcgtgcattatcaagtgggcccaatataatcacaaataagtagaaggaaagtcagagcgagagttgtggccacagacacagatcagggtgatgcaattgctggctttggagatgaaggaagaggccaggagtcaaggaatgtaggtggcttctagaagcttgaaaaggcaagaaaagggtgtcttctctagaaacctccagaaggaacatagccctactgatgttttgattgtagctcattgagacccattgtggacttgtaacctgcagaactgtacgataataaatttgcgttgtgggccaggcacggtggctcacgcctgtaatcccagcactttgggaggccgaggtgggcagatcatgaggtcaggagatcgagaccatcctggctaacatggtgaaacccgtctctactaaaaatgcaaaaaattagccaggcgtggtggtgggcatctgtagtcccagctactcgggaggctgaggcaggagaatggcgtgaacctgggaggtggagcttgcagtgagccgagattgcgccactgcactccagcctgggcgacagagcgagactctgtctcaaaaaataaataaataaataaatttgcattgtattaaggcactaaattgggggcattttgttattgcagccataggaagttaatacagatgctgaagggtttcatgtgctcaaaaccctgataagtgaaactgtaatctctaacagtaacttttgcaatgtctcttaaatctgctctcttgcttcagttcacactgctaacactgtgttttttcaggcataataataataggatttattgaggcatcatataatgtcccatttccaagcattggtctgcaccttccacatgtattaacacaattaattcttttgacaaccctgtatgataggtatttttattatctccacattacagaggaggagaccatggcagatagacatgaaatatctcactcaatgttgtataactgctaaaacacaggatttgaacacagctttctggtagcaaagctatatttactcttcccagaatgaacttcatggcccttgaactgcatggctgtcaatgaaggtgaacgcctcactaatttaccatctatgttgactgttgaattattgtggcagacagaattttggctcccatgatctccacctcctggtgtcatgcccttgaatttgtgacgtttcatggaaaaagggactttgcagatggaattaagtgattttcaggtacttgtcaggcatgggggatatagggctgaactattgagagattaacaaataatgagaaaatgctaagagaaatctctcccgttatactcccatagaaatactttcaaggcttcagagatatgatatttcaaatgaggaaacgtccttatcctccatccttccttacttacaatccaggtttaaattctttctgtaaacttccctattctttgttcagatacctttatgcttctccctttgcccatgtatttagttatttaatgttccactggactataaactttttcagagtaggaactgttttagaagtctttgaattcccatttcctatcaacttcgacgcttatatagagaagatcttcattgtttgttacttgaatcgattattcaggaaaaactcctttacaaaaaatcctatgacagggattacattgttataggagctccaaattccaatagaggatctgttcacttcagctaatattcatccacaataataattctttaaaaactttatattcctcaaattattctacaggctttcctaataaactgtcatcataaggaagaaggaaagccatcaattttatgcttttaaggaaaaagcatataattttttaaatgtcataatttaaacttgttagtgaccccttatttcttctgggcacatgataaaggctaagaacttttcttctaagcaagatgaacatctcacccactcccctgacttttatataatttcaggagtttgctgattgtgtagagtccaatcttgcacatcctacagggcacacagcctcagatagagaacacctgaattaggtggatgagatgccctgcccttctgcgcttgactttctgcccagtgcccccaccctgccctctaccccatccaaaggtctttttgagataggattatttcagaagtcagtcaaatgtgcaatctcagcagttctgcttctgtgctgccccagcctgactagtgacaaccctgctgatgttccaatcctaaacattatcttcctctgacagtccacattagggaatcctgcctcaataagcttttccaatgggcctgccaccaatggcattgttctgatttgttgggctgaagtgatctctctctttccaggcctcaaagatggcgaaagagtgcctggtttcagagagcaatacgaaaaatgcagctttggaagtctggtgagtaaacaaatgaagccagacgttgacacttgtacatcaatcatgttcatttttcaatgtgcattggaaaggtttgagactcacttgtctcagcaaacagggttcaattaaaccagtaccctggataggccataatggacactccaagggcctttctggaaagccctttccctttggccaaaggcataagcaatgtggggtagacaggagtcttttgggtaacacgtaaactgaacctgtcagaggatgaggggccctgtctgaacggcaccagccaagggactggctgtagcagatatgatgatgcattgccaactgccatatccatctgcacccagatattgctcctagaggtgtcaaaacattgtaatttacaagtaaatgtgaggagaagaaaagttttgcagacatgtttcttaaatgaggaagagaatcacagatgaggattactgtccaaaagagagcttcagcaactaccgcccaaaactcagcgtgagaatggagatatcacgtaaggtgctgcctacttggctgatggtgagggaggtacaaaacgcagaggagccgacaggcacgtggaggggacagcgccaggtgggtgggaagatccagggagataatgcacatgacgtgcccagcacaatggccagcaggtcatgagtgactaataaaaggtggctaagaatcccaccaaaaccccaggcccatgttagtcctcatgtttctaaggggaagtgagttgtacttattgaaagctaggtatgttacataattgactcctcaaaacaactctacgaggtaagtatttttgcaaatgaagaaaaagaagttttaatggtggaatgatttatttaatgccacactgtgagggcatggaggacaggcattcaagcagggcggccctcgccctcactgggcctccctgccccgctttgggcacacagaaaactaccaggcaatttggacacctctaatcactgggacatcaccacagggtattacctttttatggcaaagccccaatctactagaagtcaagagagtaaaaaacaattagagcaatgctgtccaatacaactttctgtgatgacggaaatgttgattgagggattaataaacaacaggaaacatggttactgaccactagaaacgtagctacggtgactgagaaactggatttttatttttttcaaactttaattcattgaaatttacagatccacatgtggctagtggctaccacgtgggacagcagagaactagactacctgatttaaaaggaaccctagggctcatttgccctcatttcaccaaatagggaaatgtcctttgctttatgcctcatgtgttcatccagtttctcatagcacatttttaataacaagaaactcttccttttacttgggatctgatgcctttgttagaaaaatcatcccaatctaatagctacatcctcaggtgttataatctggagataaagttaagttttggtaataaacccgttcattattccctggggttatctcctaactagctagctctgctcttctcacacctggaagcatttaggtctctgagggtggccccagaggcatctaaattctctgggtgcacagtgttgctactgctatccacagcgtccatgccattccatcttgctgactggtactgatgctgagtgcatggatgcgatgtgaatctgagggtattttcctcacaacagtgcagtgctgcttgctaggtttcttccccagggcccgctcagccccaccacctctgcagccagctgcctggtggctgggctcgggagcctgcaacctcccaggcccctctaggaagcagctccctgctcttttcctatcctcataccattggttcccctgagaaatgctgcccagaggttaaattcctttggcctggcctccaggctagaccatatcttccatctttgggcaacttgggtaccttagaaaataaaatcctgtattatcttgtcaactaggaataaattctgttctccacttgcttatttctaccagctgagtggtcagctacccatctggtcttttccctcctgcttttatctggccactgcccccagagttcagtctgggtcaaacaagtgctaaagaaatcttggttgaataaaagactcagggagaatgacagtattataaaatcatttaacagaatttttcattatatgcttgtggacagaaaatgtgaggggaatacatgttacaacaggtagaatcaagatgggttgaagcgaagaaatgcaacgcttagttctattcatctattcatctaataacaccttcaaaaacatacaagagatcaaattggcatggtttaattttagggaattatttcacttctcagttccttagaagtccctgttaagtgaataattaatatttcattcttatgcatggtgatatgttataaaacattgaaccaaaaggaagtggaggcttttaaacatgccatattaggactaacccttattttaaattaacttcatctgggcttaaacaaagaggggagagaattaagcaagagtttgctatagaacactgaactatctgcagtgtgatacatgtacatgaggaaatacccaaaaccagctaagaagaaggattatgaagactacattgactttgacttctaagttcatcactgagaatggcacctttattctgatagacttccgaagtcttactattctgcattgttgtctgttataaggatttaatataaactctactgatattctctaacagcaccgtttatgcactggatacctgcagccacctctaaggtggcacatgtaactgttccaccttggatagtatatgactcactaattcaattttactttgatgggtaattacgcaacattctaagggtagatctttagagaaacatatcttttccttcaaacctggactagtaatttaacaaatagtaaaatgggtaaatctcccaaacacttagttaacactctgggatatatgaggctcatgtaccaagcagaattctggttcacagtaggctgagagataaccatctggtctcccaaaaagtaaggacagacaaaatataaaatcacactgacttatctctgtaagtctggattttgggtttgggtttaatttaattgggtttgaagactcctagtttacttcctaatcatttcagaagcagacattccaaaattaaattaagcaaagaatattaaatgggcagacagtgcatatttgtccgtaagaaccttacagtgttattaacaatgttataactacaattaggctggcagtctcatggggtcagtagtattgtttcttgttgaaacagacaagcaaataaacacaaggagccttgagtaaaggttctttcataggttgagatatacatttccactgacatgaaataatgtcctattacaacctttttatatatctcactttgcaaatcaacctcatatattacttgttttcaaacatgactactttccaaactagatttagttttacacctaatcatagaagtagaacctgttttttaaaccataattattcatttttaattgttattaaaagaaattctcatttaaaaatccttcaagagaagaccaaaggaaatatttgcaaagcagaggcatcatgttatggtggaaagcaaacagattgtggaatcagacaggccagagtttaaatctcagttttgtcacttactaggagaataatcttgagcaaatttaataccctccttttcatataaaacaggggtcagaacggctaccccagaaacttccagaaataaagacaatgtaagaagaacaatgtatggtaaacacaagtccatagaaccttcttagtaagttaaagttcttcttactctccttcttgttccctttaccccatcttcatcttattcttagtcatggtcacataaaagtggatccagcatgggatggagatgaaaagatgttcagtatggtgctgtggaaagagcactagcctgggagtcaaggggcctgtgtgttcctaaaaaagtcaattcctctttttttgggtcacagctggagaaaaggtatgaaggtaacataagaatttgtctatcagagcttaaagcccaaaagtgattttgtagtctgagtcaatcaggaactcctggagtcccaggatcaattgctgtctttttaatgaagggcagggcaccagggctgcagtctggactgctgctgctgctgctaatacaacttaccacactggggacggataactttccaagctcagaatacagatcccaattttttggggggaacttatcagagttttccgattgatctcatttattaagagtgggcttattaagaacagatacagaagtttccctcctggatcattaaactctttcttagacagcttagattgattaatagggaaggaatgggcagtagttttcaaattatagacagcccaggtacagggtggggtggggtggcttggggagagaatttagatttgaaacctcctgttcttgcgtccatgtgagtagtgctgttttaaattgttttacatgttttgctttatttgaacacagactttggtggttaaaaagtacaaaatgcactgggctaagtgatactttgagttgttccagacacctgcttctattgatggtgtgtgttcttggaaaattaataaagaaaggcataatgagatgctctttctagaaactttagcaatagacagggcgtaggccacagcaaattagatccagccaccagagtggaaagggcaggggctgggactggaaggaaatgtcttgaatatccatcaagtgtggaattagtgttattttttattttatttatatatattttttgagacaaagtcttgctgtgtcacccaggatggagtgcagtggtgctaccttggatcactgtaacctctgcttcgcgggttcaagcaattctcctgcctcagcttcccaaggacctgggaactacaggcacatgccaccacacccggctaatttttttgtatctttagtagagacggggtttcactatgttggccatgctggtcttgaactcctgacctcgtgatccgcccgccttggcctcccaaagtgctgggattacaggtgtgaaccactgcgcccagccagaatcagtgttattaacactgtgagtcacagtgtgggtaacatcaagataacttgaaaataagaggagctcaggaagacttttgagtgccactgcttttccccgcctctctccacaactgagggccatggaaatgccacttagcctctccagatctcagttgtctcattgtaaactgacaatcttggactaggattcccttccaaattatgtaataaaatagctgcacaaaaggaaagggaaaagaagtgagagaagggagtactggggaggggaaagtattgctgagctcagctctcttgctaaagagggttcacggggtggggaaggaaggaggaggggatgaaattaaccactggtatgggtttctaaggcttgtgtcagtaagatcagtgaacgaagaaattaaggtcctgcctagcatgggcacagtgttccaggagtgtcatgccccactctgggggctctgtgatgtggaccatgggtggggcctcgtaggcaaaagagaagggctgttgggaggagaaatggggatggggaaaatcatttcaaatttcccatgatggaaaggctacaggaattggttatctagatttacaaatagaatctaataaataaaacttgtttttttttattttttgtttttatagcagtgtgaaagtcaaagtacatgtttttaaagaagcatgaaagttcagatgagacacacttgatggcttgttcagttcatgagatcttctggcatgaaataaaatgtttctttttccatgcagtgattgcgtaactcaaatatggcaaagctacctacacgataattttcggcctgtggatttgatttttcataagcctcaccacacacccctcacagaaagctcttgtttctagtggattcgtttcacctcctttgtgaaagccttagagagaaggcagtaagcagggaaaatcagctatttataggcgtttttgactaaaagtgtctgctcagcgtgccatggaatacttccaagaggtgggagaacaggaaacgatctaaaatcgactagaaggctggaggagtgttatgggggaatgattttgcaggggagtcattttcagaaagctcaggtttcatttgcaaacaaatgaactgacaccccttgagttacagataagcctttgaaacttttgctagttaaggagagaagacaaagacataaaatttctaaggattacaggtagggttcctttaaaggactttaaaaggaaaagtcctgtagaaaggcctctctccctacttatttactgcctaaggggatgctagccagatggacgtccacagaggagcttagactggcaggtggcattcagagtgtaaactgcaggtcctgggatggcctacagagtcttatagtgtccataggatgatctctatcatcactaatttccacttttataaccaaaaatggcaagcctatttggtcaagttttcataattaagagatataatttcattaaatgtattaaacccttcctgtgaattctgaatggttttgttttcattgttttgatgacattggagaagcaggcgaggtagaatttagactgcccaaagtcacagggctcacagaagaagtttgaacttccgatggttctgtggagaagaggtcatgagagagatctggcttcagtgtttacttgctcttttcaatttctacaacattagaagaatgatatacctggcttagcgactttgggcacgagcaaagaagagtgatggccaaggacatttggtcatcttctatcaatggtggaaaagcaccacggaggaaacactccacagagaacctggttctcctaagccaattaaagaggtgatgatggtggatagagttcccttgtagacacctcctatgactgttattactaattaagcttgtcctgttgacttaccagagctgtctggaataaggcagcaggagcttgacagacttaacgtatgaaaacaaaagcaagtgtgtattgcgttttttttttttttccctgtatgaatacactaaagcttgaagaagccagaattatattccatcagccaatatcaagccatgggaaaacctgatccactgaggctgagctatcaaaagattaatccaggctggtgcagtggctcacaactgtaatctcagcacttcgggaggccgaggtgggaagatcccttgaggccaaaagtttaacaccatcctaggcaacatagcgaaaccccgtctctacataaaaaattagtctggcacggtgacctgagtctgtagtcccagctacgctgaagggtgaggtgggagggtcgcttgagcccaggaggtcaaggctacagtaagccatgatcacaccactggactccagcctgggtgacaaagggaaacactgtctttcaaaaaagaaaagaaaaaaagattgactgtgatactctcgacttcagacgaaagctttctgcgtttagtcggcacacaagacagtgaaattttacacccacactgtgattaagacctactgtcatcccatattggaaagggcttttctttaccacagaatcagacatgctaatcccaatgccagcttaataaaaactagatgaagtgaaatacaaaggaaaaagtggtatggtacatgaaacatgggaaagagctaaagcttgttaatgtttgaggatctacaaacttggaatattttcacactgtatttttcatttatttctcaaatttgaagttaaatttgtttctaagacctgaagcaaacacagtcatatcatcatgcccattttacagatgtagaaatagaagtgctaagtagagcccaaagtcatgtagcaagccagcatcaataaagcttgcagtcagagcgcctgaatcccatattttcatctattaggctctactgcccccttcagtaaatacaatgagaaattaagccttacagttccctagaactgggttacttaaaatgcagttctgggattgatcactgtcagaatcatcccatatctatgaaatcggaatctcttgggtggatgccagagatcctcattttatagacactctcaaggtgattcttgtgcacataaaattaaggaagctttacctctaaatattcaatgatagagcaagtggccatacatatatatgattctctacaggcatacatgtgatattattgtgcccatatgtacccgtattgattccactttacaatatttcatgtagcatttccaattttagagataaatcctttccaatcacttacttttacatgtagggggcaataactaagagattagcttgtagcttttagcgtatgtatcctgcacactattcctctcagatttgctgcagttgctcccatttaatatatttggtcccatggtcccattgttccaatacgtaattcctacctgtcacaccatacatattttatacataaatacatctatctatctatctatctatctatctatctatctatctatctatcaaataaagtttggcctttgcaaatatggtaacagctatgttaatttttatcctggagaagtaagatgagggatgctgatttcaaaggagtggaagatgctggaaggatgcatgctgtcttcaaaatctaaccagggctctgagcaaattccctaaagatcacatatcctaatgtgttctgctctatgcatcctcctttgctacgtggtttaccatgatccagggaaaactcatccattaaaggaggaacacaccaatttcttttctttggaagttaaaataaataattgcaggcattatttagttaatctttgcctcttctgagactgttgagtcacaaacttgcttcaactctaactttcagataatgtcgcttctccctttgcttccctgtgccttggccccattgccttaaaaggatgttatgagaatggataatagaatatgtacaacataatgggaagagaacagcactggtagccaggcagtgagcctgcgagtgccaggttccactggcaagatgactgatttcatcgaggtatttccttaggatttttctcttttcaaaaaactaaattggactaaataatttcaaagccttcttttacaaggagattattagatgaaaaatagataggaagatacaatgtccgcattgcagggagattagtgtgaatgggaagctacaccagatgaccttctgatcaggaggttctactattctaaaattgtcattttaaggggaaaaaaacccaactctgcctggtcctttaattatgtatcttatgattttagagtctcggagaattaaatcagggaggagttagacaatcttgcaagcgtatattaaattgtggttaaaaaaattaaggagagcaaaagtcatttattttacaattgttggattctcccttattaaggggactaaaacctctttattcttacaccagagaagcaggacatccctaactagtctacacgaatggtccaaggtgaagttcaatataatcactggaaaagcacagtaatgaattttccaacgtctatgaaaaatctgtttctccacttcatagtcatacctcttccatggactttgtgaaatggcactcttaaaatggatctgagttcatgaatcagagatcaaaaacagcatgtgtataaatgcatattttagaagtattgttgcagggatacctatgcagatagaaggtgtatatataaacctgcacacatgcacctggcatgcagtaaccgcaggctcacataattctgcttcatagacagttctgtgatatcacaagcctgatttttgtgggaagtttcctaattctgtgaaacaattagtagaaactccagttgacagagaacagtgacctaatatacacaaaaggacccacatatccagaaaattcattgtataaatatatcttagaaatggaaaaaaagcaggcatattgctagactttagcaaatgaaacaaaaagtttttaatgagagtcctaaatattcctacatttaaaagatcagggaatcagaagaggtctttctttaatcacgtgagtgctctccaagacaaaaaaaaaaaaaaaaaaaaattaaaaacaagaatttggtcaaaagtaacagtaagagtaaatgttatgcctttctttacacaatattttctcctttatctctgtgtaacagtaattaattgattctttatatcattaccttttagtttataaacatagaggactgggttgaatataagtaaatcagtcactgaaaaaaaattaatgcaattacctattgtggttttaatttaagaatttggaaaaacacttaaatatgaatttaccaaaataatgtgaaaaaaaaattctccctgtgtgataacccactaagacagattgttgtctttgaacctaaacccaaagtggtggaaaacataatctaattacaaattaaagtcagcctggcaatactgcatatattttttagcagttcctaaaaaacctgacacaaaagagcaatgtgttctaccattcacaaatcactgtgtaaaattgtgtaatgccatgatctcatgtgggctagagactgtgggtgaatagttctcttaaagaatggtgaatgattaccttgatttactgtctttaatttgcaatcaagcaaactgtcttctgaggagaatggaaaaaggggaaacgaaatctactggccactgagagatccaaggctagtttttctctttcactctttgctaactaatgctatgcctttaattagtagattggaattctgtgagatcagaaagtgtgtgttacaggcagaaacctctgactgtggctaaccaagcactttggtgttgccgaaaatgtctttagaaaacagtgaaactgaaggccaagaataataaagtttctttaataacttccaagaaggctttcctatatatttttgatcttccctttactaccactgagtctttctggactgctgctttctcacaatgttttgtcaatttttttttccctttattaattggacctgacaatagtgagaataaaagagaatcagagagagagaattaacagaattctgctgctgatcactgattccacatccaaagttagcaccaggcaggagcaatctcatctttttatgaatgaagaggggcatctctaccaagatcagtgaaaaacagggagaagattgtgcaaacccaataggaaatccattcaggaaccttgacattcacttgctggattattagggcaatttaaattaaaaataaagaaaatcatcaatgaatgtggtggatgggatttcagaaaaaggcagcaaagaaacatcccagtagccaaagtcattagcagaactgttcagcactttcataaattgcatgtaaagtagttttaactgaattgggagacttaaaattgttctaacacaagagggaggaaaactcagccagggaaagaaaactcccactgggcaaagatggaaataatcttgaaccaattattgaaaaaaataattttacctgtatttaaaagatcctggattcatgcttatgaatgcttcctcagtgatcttgtgtggtaccttatttaagcagacccccacccccaaaaagagcaatcatcataaatgttaattttgcaaagcaacagtaactattcagaatcctggtcctggaaaacaaccgatcatatttcaatcaccagccatataatatcctctaagagcacctagcagatctaaggagatcatgtgtcaattaaagattttataaagcccttgtggagacacagatttgtagatatctgatgtctccatctgcttttttactatctgtgcacacattaatttgtcagctcttccagtctttctagccattatttagaggagaaataaaatcacaaatactaccccttcctttccctaccacaaaaaccatccaaatcaacaccacactattaccaaatacaaagtaataaaagagttatacccaaacctggtcagtccttccatttcttgaaacttgcacacaaactgaagaaacccactcagccttaaaaaggtcgatcattttgctttcctaaaatttcatctctgggagtgctttccttctcggtctgtcttgctctctctctcgctccctctgtctctctctctccacttctaccgcggagagagcgttttgtttcccttttcctgtttctacggctgaatgaatgcaaaatacactgtttgaagggatttttcttttaggttaacagttggaaatctaaaatcttgctcttctgaatggctttatatgtcagtcactcaacatacaacatttacataaagaggcataaacagaaccaagaattctgctttttaaaagcaaaaacaaaacaacaacaaaaaccaccttttattctatctctgaacctcttcctattttatttatttaactattaagcacttaccctgagatgtgccataaatgctttattccaaatgtataagagccaaccacatctcaactgagaattaaacagttttaatgtcttcaaatccatgttcctgctcccaaccctaatacagacagtcactggcagcggtacaatagttctaaacagc

SEQ ID NO: 247 - DNA, 378738 bp, Homo sapiens; identical to SEQ ID NO: 246

SEQ ID NO: 248 - DNA, 959237 bp, Homo sapiens
agcagtgcattaattattttattaatttcttctttttacattatgggaaacattcatctatttacaatatttttttgttcacacacaatctaggtaaataagcctatgaaattccaattcataaagccataaaaatgttcccacccctccatctgaaggctttcaaatgaatcttttttttccaaaccaaaataatttttaaaaattacatttgggaattcagatatgctagtgatttacattccagttatttaaaatatgcatctagacatgttttaaaaaagaaatggtaaattcacaaggataaggcttaaatgaaagtggtaatgcacagtaaaacattaaggaaacatctataaataacagaaatatattacaataaattagttctatttaccatttcaaatattaaaaatctttaatccatttcttcatctctctttacaaaaaggttatgtgaattgtatggaaacatctgcaaaaaatataataaatacttaatttctttgaacgttttttgatgtgggagacaaacttcttttgtaatccccccctccccaagaaaatgcccaacacctttataccaaagttaaacaaaataagtaatttttcagggtacatacattttccattacgaactaaaaaacatttctacaaattacatcaaaaagaacaatgtaacaaaggttatgctcatgaatgtcagtttcaggggtcaagcagcattgtgtggggtcatgttctaacaccaataattagctttttataaagtgtttgtacaatttaaattgtattttcaaggaaggcaaagatcatgatgccctgtaggccttgagctaaaagatttaaaattcttaccaaaaatagcttatgaatatacaaatgccgttcacttagacaagataaataggccttctcttgtctctctttaaaatatcatgggctaaattagtttccaaagaaaatattgtaggatgatcttgagtcgtattagaaatctatttcttaatccaaatctcaactctacctcagggcacggagctgtaattgtgagcatgggtcttgggatgaacgctgcttctttcatattaatctgtgagttccaagtcattctcagtattgaatgtgaccataggctacccaagtggcagttggccctactcgatgcaagctttgtgtgacttttaattgctgctacaaggtaaagaaaaggtgtattctttttaaaactagcaaatacttgaagctcaaaatctctgtatgctccaatttcacaaagcactttgagtgctttgttcaccctagttaaaagttggttcgttggtttcaaaataagtgagtagcccttttcttgtaaaccacagcagtaaacatttgtgccctgtttataaaggtagctcaaagcatcgatggctctgagaggtagcgaattctctagtggttttagaatatgtccgtgaaaatatctgttgctagaacccatcacctctcttaatttcataagtaaaattaaattagcacctggctatgagagtgtattattttaaaaagcttctctggtgcaagcatgtttgatgtatgtttttaaaagtctttcgtttttaatttctaatgctttaggatgttagctggacataaaatgccattgatacttaagattgccacatcctaagtgtttaaactgtgacgagtaagggcatttaaagacaacttcagctagacaccgatgcatactgcccatcaatcaagactaaaaatctaaatcaacactctctgccaaaagccttgacttctttcagtgtttatgaatcatgactccccccacctcttcatggctgttgaccctggcaggtcgagtttcttctctcactacctggaacctcaagatgacagcggcagctcttttgaatgaggcagcatgtctattggggcaaaaatttattttagccatttgacacaggacagaatcctatgctaggtattactggactctgcagtagtgagaggagatgaaaggagaaaatatatctgaaatacgaactacttgggttaaaatagacggatgtgtagcattcaaagggatggtaggaaaacccaaactcttctccaaaaacagccttgctgccatttacagcgctttataagcagatatgtacttatatatgtggaatcaggtaggcccacctggatggacacttaacaaattaatagaaccaacactttccctttaaaaacagccgccacgacaacaatataaatatacacagtacaataagagttgagaaaacatttcaggtctagattttcttaataatagaacaaaaaaatcccttatgtagtatactaaaccatcagtgcctcctttgccttgcttcatgttattgcctttcagaatagattaatttccctgaaagatcgaatttacaatcttctgctgattgagacatttgaagctgtgattgatgaagtaacagtgaggcagtttgtgcagctgtgagtgtgcaggtgcccccagcacctgcagatttcgcttctcccatccttgctacacatccaggtcccccacccccaggccaggcttggtcccctctctctgtgtccctcatggattccagtgagatggtgtgatttctgaggttgggaataaagtgctccatctgcttttttaaaagaataaccatttaggggaaataaagggaatcggaggcctagtttctttcacgtggaagacggtaagtcccaaaggatcaccctgtgatactggatttctgaaataccctatggttttatattgctgaacagactagctcgagagaactgaggacggcgggtgacctaaaggcatcacttctacacaggtgggtttggctttgcccagaaaataaagggttggatctcagtatgaggcagggcgacggcatcaggacagggggcgaagctcggtgaagaaggagatgggcaaacgggtacgggaagtggggggctgaggggggcccggggggcggctcctgcgaggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcactggaggaggggcccttctctcctgatcaaagcagaaggttcaggacattacacagcttctcaggacaagcttgggaaaaactgggataggtcagtagttagaacacacagttttttacctaggggtggttagttctgatctgcacactgcatatctacttttttcttcattattctggcttgggcattcaaaagatgcagaaaaaaaaaaatcccggtaagcttaaggcccagggtaaggctgggttgcagaactaggtctctccaagggaaggaagtgggtattttaaaggccccctgcggaaagcctgcggctcccagcacattgagtgcggttctctctggagactccagactcctcctggtgccagagatgggccaggaagcagcggctgcagcagcatcttagaacccctgcatcccctctaaggatgcaagtcaccgggtgcaagcttggttcagagcttaaaaacatctccgctctgtccccggcccgcccaccgtccccttcccaccaaacctaaataaacagaggaggaagaagagatatcagattgtgttctttagctttgttggtgctacaccaggttagacccttttgcacaccacacacgaacacacaagcaatatacaatatacagggtcacgggagagggaggccattgatatttcctacactcgagagttaattaagtcagttccaaggtgactctgactaggggcctcgggataactgtggtggcccaggaagcaattccaatcacaggggcagaaactgtgccatgaaaagttgacacaggatgaaagaggtcattcctcttatcagcagcaaactatgaaatgggcggatattttcaatgccactgcaaaaacaaaagacagtcatctctttggcattaaaaaaaatgcagcaggaaagaatggcgtctagaccacaaaggatttttaggcaaagaaggttgaagttgtagactgtgaaagggtgcacataaaactgatgttttcattttaaataaaataccctccattctcataaaatgaagcgtgaacattatcttaaaatatagtttcggtgattctccaaagagtactctttgtatcttaacaccaatgctcagcacagcaattcctccctgcttgccagagcaagtgcctagttcaacttctcaccctggagctaccccaccggctgtctaaggtggagtctgtgtggcttaaaagagaaaaaaggagagcctggagtgcaaactatattctcccaactctgattgtgcttgttcatttttctcctcaggttcatggggtgatgaaaagctctgatcacaggcaaagtccattaaaaaccgtaaaaatcaagctaactaatgatttactatgtaaatatcaataggttacatatatcaattcttagcatctcttcttttagacattttaaatcttcattgtggaataactcagtggatatttttagaaatatgaatattggatattttttagtcattttcctttccttatacatttggattttttaaacaatgattactattattattattattgagacaagctctcgctctgtcacccaggctggagtgcagtggcgcaaccacggctcactgcagactcaaactctccgagttcaagcaatcctcccacctcagcctcccaagtagctggcactacaagtgtgtaccaccacgcccagctaatttttgtactttttgtagagacggcgtttcaccatattgttgcccaggctggttttgaactcctggactcaagtgatccacccgcctcagcctcccaaagtgctgggattacagacatgagccaccatgcccagccaacaatgattatttaaaaaaaaaaaaaaaaaattagatgcatcagctctggaaactaaattaccagtatgtgtgcatttgtagtgttttcttaaaataagactgatttaaagcttatctagcagatagttttaaacacagattaaagaaaactagattgggtacaaatgtttggcttcccaagtgagaggccacatgtacatcaacagtactttccaacttaacactacgacccccattttgatggtgacagaattggaaacgggggacagtgatgagagcatcaccctcctgtcacttacagatggtcccttgggactggatttttcctgggagaccattgaccccaagaaccctgaaaacatgatatgcggtagcagaatggattagattgctgttagctttctggtaggtgaggggacctgaaaagaacagggccaccagcatttcaagggaacagccattccaattttcagaggttgattctcttggaattatttgacctgaggccataggaaagcaaagggttaaaaaagtcacgtttgacatgccagcctggggagctggacattggatacccgtgtgagcctcgtggaacaccataatcaaatgtgaaaattagagttgattaattaaagtaaaagaatttaagtctttatttctaaactgatgcatgaggaccccagtgagcaatattccccaaggcaaatcaaccaaaagcaaaactgttttgaaaaaaaaaaaaaaaaaaaacccaacatttatgtaattactgtgaaactttatggtatatatttttagacttgaacaacagtaatttctttattactatatttatgaaatgattatcaaagtcagttatttttcagggcatcctatttttcttgaaaacacatcctaggggtgtaaggaagttgaactcttgttctatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactcccatgaccatgctgatatgttatgaatatctctttttgttataactaggcctttttgtcttccattcctttgcataaagaatattacccattcaactagggaagtggttgtataaattatagtacaggaatataatggaatactttgccattgttaaaaagagtgtggttaacccacaagcatttatataaaacaatgtttaagacctaatttcaagtgaaaagagcaaattgtagaacagtatgtataaagaaagtttagacatgggtatatataatatatgcttagaacatttctgaaaagattcataagaaacagaattcttacctctatggagggctaaaaagggaatgaagaggggagggggactttaacacattattaaaatatttcttggtggtgttaaaatttttatgagtattatattttgtaataataaaaaaggaaatcttcccattatttctaaataaaaaagagacatgtgggtatggtgtatattggagaatggcgtatcactacggcaagcaagacaaaataatagcagcagcaacaaggagatctgacctgtggtattaggctgtttttgggtcactagaaagaaatacttgaagctgggtaatttataaagaaaagggttttaatcagctcatgattctgcagggtttataggaagcacggtgctggtagctgcttctggtgagtcttcaggaagcttacaatcatggctgaagatgacagggtgtcagcatgacacacggtgagagcaagggagcaagagggtggggaggtgccacactcttgaacaaccagatcttgcgtgaactcaaagtgagaacccagtcgtgttgatgaggacggcaccaagccattcattagggatccgcccccaagacccaaacaccttccaccaggccccacctccaacactggggattacatttcaacatgggatttggaggggacaaacacccaaactataccacctgtccttggttggcttttgatttttggtgtccttatttatctgtgtaacttcgtatatcagccctttccggtaccatcctaatctctgcttctaccattctttccctgcagcagtacaactttctcttgtctcttacttgatttcaaactgtctccaatttgtctctctctatctcatctagaggcaggctagtatagtggttgataacatgggctctgaattcaaatcccgactgtgacacttctagctctgtgaccttggaaagtcaattaaatttatgtgccccagtttcctccttgtataacctagttaataatgattcttgtcttataggtactattagttattatgtgaattgtgtctggcacagaggaagtgcttctaagtgttagtcattactattcttcaaggtgattttttggggggttaaaattagatatatttcaacaagaaaaacaaataaagaagccaaaagaaaaaagtaagagaaaagcacaagaaatgcagcaaaaaccacccagaaagcctcttcacgagaagaatgactgctgagatgttagaagatatccttccatacatatatactcatgtaaataatatagaatatactttcatctaaataagaaaaaaaatctctcttgtaattggctttttgactccacgccacgcaggccatctgtgtttttgtttgtttgtttgtttgtttgtttgtttttttgagatggagtcttgctctgtcacccaggctggagtgcagtggcgtgatcttggctcactgtaacctctgcctcccaggttcaagtgattattctgcctcagcctcccaagtagctgggactacaggtgtgtgccaccatgcctggctaatttttgtatttttagtagagatggggtttcaccatattggccaggctggtcttgaactcctgactttgtgatccgcccgcctcggcctcccaaagtgttgggattacaggcatgagccaccgaccccgccacgcaggccatctttctaaaacaacacttacatcacttcattatctggctcggctatcagtggtttcctattgctcactttattaaaacaaaatgaattctctggatatgtaaggatcttacttagaaaagtcctcactttctatccaaagatggcttcccatttttaaatactcttctaatacatcagtcagcttaatttctttatactcagacaaaattcctcctccgtagtctgttgcctctcagtgattattcagattccaaatcgaatcctttctctttcatgaagtcatcccttcctattttcaattcctattagtttttcttttttttggacaaatatagcacttttagttagcggtaacatacataatgtaatttcaaaacttacaaataatgatacaaaattgttttcattgctcttggcggcactgaatcgtatatgtgcagtggagacagagccttatagctctcttgtctccctcagggcatttagcagcttgaaaactttgattcctctggaaagaagtcttggttgagagtgagatgacttgggtcctaaaccttgctgaagagcttaagcgaggcacctctttacttggggcctccatatcctcatttgcaatataaaagggttggaatcatctttgaggatccttttagttttgcttctaagattttttattcattctctctctgaagaaaggctacctaaaaataatgccattggtaaagtggtaaatgtttagaaactgactttttgggaggaagaagctctgcctcgtagagcgtgtcgatttccatggtgtaaatatttccatcacggccaatatcaggctcccaggatgacaaaactgaatatggagttgggaagagatgtccaccattggctctcattggacgactggaccccccctagcattgtggagtggctcctttcaatgaagaaatgcagcctcaggctagatgagcacagccagctagcttcgtctccagcttctctcactctaaaactccaacacaatctttcttcactgagtggagaaggcgacgacaatggaaagtgctcccagcttggcttttcaaacccaggctctgaaggcacaaaccccaggaggaggccagtcttctcaggcacttgtacccacagcagtgtccatctcttttggaatctggcacaggaatgatgctaccgaggtggtggcaattttatatgcagttggtaatttggatctgttccgagagctctcagctctgccttttctgggaaagaggtgtggtccaaagaactaaaagaaggttctgagctgtaagtcaagaacaatgtacagatggtggaaacagtctccagactgttcagggaaaagtcctcagagtttcatgagtcagtgggaggaaagaagttggagagaaagtagagggctggagccgaagacccaggctctgcctcgtgaggctcacaaccatgagaaagccttggtgtatcagtaaagtgttggttaaaaatcaactcgaaattccttctgacaccgttgggaggatcttatcatatgtactaaaaacatttgatgactgttatttatacttatttatgttaaacaataggaagaaaattaaaatattactagctatcaggatagatgatattttctcttcattggtttatgtaggttcatatatatatatatatatatatatatatatatatatatatatatataattttttttgagacagtctggctctgtcggccaggctagggtacagtggcaagatcttggttcactgcaacctctgcctcccgagttcaagtgactcagcctcctgagtagctgggatcacaggcgcacgccaccacacccagctaatgtttgtatttttagtagaaatggggttttgccatattggtcaggctggtcttgagctcctggcctcaagtgatctgcctgccctggcctcccaaagtgctgggattacaggcatgggccaccaagcccagccacagataatttttaaagaatgttgcagtagttaatgtgatcattgaagaacacccttcccaacttcaaaaggactagttaatgctggtgctccctgccccctcatagaactagaaggaactgggattccccagatgaactgaaggaaatacgctaatattcaaagtggataacaatactagggatggctgcgtggatatttttaacatgctaatgtgtacctgccagactgagctcccagcctccaggtgggctggcaatgcaaagtagggttgagaaggaacagggagcttttcagagaaccacagattcagaagcagagggagggggaagaattgaagagaacacagacgcagtgaaaggatgctgggcagatgttagatggcagctcaactcaaccactgcgcattaaagttactcatggagggtactgttcagggcactttaggcatagagggattgtgtaatgatgcgttagcatttgttcaacatcccctctgggatgacgactctgtgccaagtgcttcaaaaacattctttcagatagcattgaatctcttcctacacgagggacagagaaaataaaccagtgcttaagaaagctatattaccttgagaaatgttaacacagtgcttcgggaattcttaggaggaagaaataatggctgacagccagaggttaaatttgagaagaagatttaaaagaatggagactttcttctcatcttctcccccattagatcgcaagttctgttgtactgggaatcctgactactataatatatcccaatgcttagcacatagtaggtggccaaaactgataataatgatggcgatagctaacatatgtggagcaactactgtgtgccagggactgtgctaagtgcgccacatacactgcaccttctcgaatctgcataattacccttgaacaaccagtggcttgttgaagtggcgtgatgttacttcccatacaagtgttctgtgcttgtaagggaatagcaggaaagaagatctcaaaggagaatggtgtcttactgtgacacttttgaatgttacatttggaactttgtgcctagacaacatgggattcagagataattttttagcaacctggtagaaagtcttagagaaggagttggagcagagagaggctgggggcgtcaatacaaattggtccattgcaatcactcaagtgaaaaatagtaaagctggaagaggtaagaggtgagttgcaaagtttcaagactgtatttaaaaaatggtcattccactgatagaaagggaagtgtcaggaagagaagtgatatatttagggagtactgtgttatgtgggtgctttgaaatctcttcttcctgaatgctgagcttgaaaatacaggatcaatgcacatgatcagacgatggtgcagatcttatgctaaagtcttagactctttaggctgtaaagatcttatatagatattttgtctgtcttgctcaggcagaattatcaaaggtctcagaggaatataactcagcttgtttcaaaagaggccttggaagttttctctaacaatttccaaattaattgatgtgataattaataactttgcacttagaagttcctccttgcagctaacctgaattccttgggctgcaattttgatctcatttcctcctggtttatagataggaatgttgatgatgttgctatttcaaatgcatcttctgtaaagatacatttatttaggacttacacccagcttgcttctaaaaaggattagaggcagctcctaatatgtccacctaggcttccttttaaagaagcttttctcattcctgcaaaatgtcttccatctgcatgcataagaagaatttctttaataataaatgatacagcaaaagtaaagctaataacgaactatgctgacaaaatagtaacctgtaaacaaaacaaaacaaaaacaaaaagaaacaaaaaaccacaatcctttcttatgccaggcaatgcagatttttctcatcagaaaataattttgaccaaaactatcaattttaacaccgccagcctctgaattttaagttcctttcttctttgtagtgcctgcttttgccattcttagactcgtgtgtgtgtatgtgtctgtgtgtatttttctcttccacttgactctggaaaaccagattttagtaaagcatttagtgaatattgaaaccaaggtataaatgatggacacagtacttaaattattaaaggtaccaaatgtttgttgcatgaataaatgagtgagtgagtgattgcatgaatataatttgtgattgtaattagggtgttctctttacctcgttgtctgcactttaacgggaacatagatattaaattgaataaatggcaggtggcagacagaaaagacgaaggaattttgaggctctctgcaaagagaagccgtcctggaaggacagtgggcagcatctctgatcagcactacctaaaggaagtgaggagtctttgttgccagaaaccttagccagggccttccctgctcccctccctctgctgtcttagggctttgtttacacagccccttgaagccagctgtcaagggtgcaaacctggtctgccatcctttgaagaaggttcaggttacacatggtaagccacagaacagagaaggcccaggattcattattgtattagtctccacagagctgaacccaggctcctaagagtccgtcccttcttcctgtgtcctctgtcagccagcgccttctgcagctctgatcctttggtcattggtccttctttcctgcacctgaggctaagcctgagtcaagatgttctcaagatccttcctgtttcagctgcatgtctgatgtttacacttgcgactcagaactcacttcactgcaggcttctgacgccccttcaaatccatgcttcactctcacaatctgttttgaatgtctgtttttcctgggtaccacttctcagttgtccacacccagttgatcttcctttcccctccattattaaacatcttttaaatagctcatcactgcagtcttagtaagttcaactttccgtccagctttttatcttttctggtttcaacacctgggctcaaatcttagctctgacatttgattgataggtaaccttaaaaaagttatttaatctctctgagatggaaatttgtcatttgtaaaatgggcaaaattgcatgcatagagttctgatgatcaaaagaaaacacgtatgtaaagcccgtagcactcagtcaggcacttagaaccttgttaaaatgtaaatatccctcctacttaaaaaaaaattattttaagttttgggatacgtgtacaggatgtgcaggtttgttacataggtaaacgtgtgctctggtggtttgctgcacctatcaacccatcacctaggtattaagcccagcatgcattagctatttatcctgatgctctctccctcccccaatccctgactcttaacttttaaaaatgtctcattccttctctctagaaaagtatcgggactttcttttattcttttgcctcctttaaaggcacacaaggagttctctcctctctatagtcatgatcattgtagagacttttcagtctacgcaggcttcctttcaacacaggcttcctttcaacacaggcttttctaaagagtaattatatagcaagaaaccaggatttggtacagactacaatactcacacatgcccacatcatttggaggagggcattcatatcccaatgaaggaacatttttttaaaaactaggagtggtgatctgggactcaatgtaataggcgattgcttgtattagctgtttttttcttttttaaataaagctgatttctaacaaatatttgaaaggtatttagataatttgtagatgagcaagtgataatttttctgtgagcaagaatgactttccctgttttaaacgtgtcgcgtttcttattatattggaaagtgggagtggggagttagaagtatagaggataatagaagaaagtattatagtcaggtcgcgtttcttattatattggaaagtgggagtggggagttagaagtatagaggataatagaagaaagtattatagtcagggaagaatgggacactaccctgggtttatatcactgatcactgaggacgtaaattcacaatttcgtgtggcaggttgtattttcttgttctccctactttgtgaggagcatttgctattatacgttacaatgatacggaggaacaggtaggagaggaacaaaaaagcatttaggcaaaacagagacatttcatactacttagaacagagatgggatgatacaaattgctatgttcccaatacagttcatatctttggggaaaaaatagcgatgctccaatcttcatcccatccccctctttctctaacaagaaaaggaaaacgaggagcagtaggtaggtaggaggggagtgtatgacgtgaggaacaggcaaggacacagcatgtccaggaggagaaaaggggagcaaaaaacgtatacaagataaacaacaacaacaacaaaagagactccagcaagaggctatggttttgggctcctcacgtagaaatcaatgcatttaaaatatccagaattaaagttgaagaagaacactccatctacctcttctcaaattattttctttaccaatactacttccttttgtctttaaactgtgaaccactactctactgtgccttgttcttacaattatacacgtcagtgctgaaaggttcctgggagacatttcctgtagactaaggatagcacctgtgggcatctcggatcgatgaatcatggtggctggagcactgcattgagactggttcaggggctcagtctgttctcaatgggtagggtgatggaatccatcaatgctgggattggctaatgctgtcttccacaggtttggggtgggaggagttgtagggagagccgcccaagtggtgccatccacgctaagagactgagactctcatttacgaggaggttcagagacattaatcaatttgccaaaaggcacacagctacttagtatttttccaaatttaaatttaaatttttccaatttatctaaaacaaacaaacaaacaaaggttcagggccagggggaaaaatgaagattaagaggattaaccatcctgaaaatgaaaaatgatttgccttcaaggcatttagaactgaaaataaatcttcctgaagccttttgttagacactttatcaaaattgctaggagctctgactggctctcttgcaacagcctggaatccttctccccagtttcagaggagtttcaaaatctgtaatattatagactgactatttcttccagggggagaatttttcttagtgcttggataaagagatgaagtattaagacactttaaactattattcatgtaggattaacagatatttgaatttaacttcagaatcttttaaatgacaccccacttaatataatttttaaaaagttctttctgcagtgtatcaaataaaagtcccagatgggatttggacttggttttaactaatcatggtagcaggcagtagtctcagttctagaataaatggcactccaagtaagagacttaagttcttcatcagtgccaggctgcaacaacatgctttgagggaactctggcccctaaatgtctcctctacttgcctggaaatttactattaaacattcagaatttttttgaaaatgctaatattcttgggtgatacgccatttcaaatttattgttagctaataagtaaggaagaaggaaaagctagtgatgaggtggagtgatttgttaatagctgtgggataagagaagagagtgaccgaaataatagttttccaagagtagctacaggaggggttttgctggcccaaagatggacttcattgtctcaaaactactcctaacaccagaatgtttaactgaccttaggccttatatgtctgaggacccaataactaacactaagcagctgatgaaaaaccacccacataaataaaccctcaagatgccttcggaaaatagaaaagaaaagagaaaaacaatgtaagaaagtgtaggagtgccttctcttcaacatttctgagagaagatgggagttgaaaaccttaaacaaaatgttgccccaatctcacttgcctaattttagttatcttggttcagggctatgattcatccctaaagctgtgaattactgaggaggaaggagggaaaaaaaaatcgacttaaatgtcaaagaagtaggaacataaatatagttttcttttttgaggaactagaattccaggatatagggatcttttttctcataagggactgaatccttcaaacttctagaaaaataatgatctgcagtcaaaacatcatcaaggaatgaaagacagaattgattatgagtcatgtcatgtctgaatttttgcctctatagtgtattttcctttttttcttttgtatctctttcaatctggttaaactattaattaattaattaattttgagacagggtctctctctgttgcccaggctggggtgcaatggctcaatcatggctcactgcagccttgacttcctgggttcaaatgatcctcccacctcagcctcccgagtagctgggactacaggtgcacgccgccacacccagctaatttttgtagtttttgtagagacaaggttttgccatgttgcccaggctggtctcgaactcctgggcccaagcaatctgcccaccttggcctcccaaagtgctgggattacaggtgtaagccaccgtgccaggccaatctggttaaactagaggtcactaacaattgtatgcagttgaagatgacggaggtttaatgtgtagactgtaatgacaaagggaactcataaaataggtgagtgtgaaacgaatggaggtaagtggaactatgagaaatgattctaggggatgtgatggtagcacagggaaggaagatatgtttgaatggttgtctaaggttctcttgtgatccttttgtggatcataatcataatgattgagttttcacagtaatatatgagatgtgcttccttcaaaccttgttatgatgttggcacactatccgtcttacataaacataggaaaaaaaagttctctttcctgccaaagaacaggggacaacagaaatggtgtggggaaactccatcctaagtaaaatgttttcaatttagtaggtgttctcctgtccatttatcaccactttgaatttctgtaagtggggagggatgaaatagcagtcactaactcatacccagttcaacaacttcaccgtctgaaggagctgaccctctaccatcagcctagctgtcatctgcatgtttgcctctttctgctctgaaaacttctgagcagtaaaagaaatatatggtggtcacaaaaatacggtccaggacgttggaggagggtcatattgtgaagaaggcaaatgagaaagaaagagtttcaatgacttcagagtgatcctccacatcctgaagctatgagagtagcccagggcacaattgtgacattgatttcagcccctaccctctagccctgtcctcagtctcctcagagcactcttctcatcttcctcatggctctacatctttctgttctcctcttacctgggtattgctgtggacaagagcaattcctctatcttatcacccaagacccaaagtgtcactcagtgaatgtgaccaatgcatcttgatgacaacctaacgggatacttaggaggtggaaaggactctggaggttgccggtttaagtgactttcttgcccattgcaatccttttcttgcatcttctggaagatgttaaccctatggccatgactacctaacattgtgtctagtggagagatattttaaggtccatagaagaatttttttttcagaagggtccttggcctccctcatttcatgtcaccttggtccactgcctttcttacaaatccagttcttctaatttaattttctgagcttctgctaggcgcgccaaagtgcaatgaagacttgtttctgttttttatttccacgaatttttttttttttttaccttgtgtggcaatgttttgggtccaattctgttctccaaatagatatattgaagtcctaactcctactatcggtgaatgtgaccttatctggaaatagagtctttgtagatctaatcaagccaccaagtttgtggtagtttgttctgatgattcttgaaaagtaacacatgtagtaataaaggcaaagaggaagggcaactggaagccaaagaaagaaggaagaggtttttttcttggcttaatttactgatgcactggtattaatttttgattaaaatgatccagaattgttccacatgaacccttgaaaaataattcatgggaggccgtctctgtccggatctttaaaatacaacatactctgctatttaaataaattcccatcgcacaatagtcagctgtttttcagtgctcttgattaacaattgggtttgttttccttaactcgactgctttgattttttgttttattttgccttttaatattttatttagtaacataaatgcatgaatagtaatgttcatttcatcaaaatatggaatcaaaggcacttaaaaatacgaattatccgtaatatatttttcaggtccaaatggaattctatctatttctacattccaagactctaaagaatttactctctataaacagcatttagaatgaaatcaggtcttgcttaaaataatcaatctcagtggtttcctgcgtagcgctattctttgtttacaaacagcacaaatacagttaaggactacagtcatatgctgcacaacgacatttcagttaatgatgcatataatatggttgtcccataagattataatactgtgtttttactgtatttttctatgtttggatatatttacataaacaaatacttaccattgtgtgagagtcgcccacagcattcagtacagtaatttgctgtataggtttgcaacttaggagcaataggccactccatatagcctaagtgtgtaataggctagaccatctaagtttttgtaagtgtactctatgatgtgtgcacagtgaaatcgcttaatgatgcatttctcagaatgtagctccgtccttaaatgatgtatgactatatttatatttgcaaaacaaaacctttttaaggccttcaattgtaatacatatcgagtgcccaaatttaaaaatgtatgtcaagaaccttcacatatccaattttaaagcacggtcacactctataagcttctctaagacaatctcttctattatgttactcaattatctgaaaaattcaagagtcttaagaaaaagttcttgtgtgtacttcgtgcctgagcaaacgttcaagaattgggatacatgtatattctcattgaccagaaatttcaatccttttcagaagccattctggattcttttaaatccagaatggcttctgaaaagatgggatttcttctgcttcttagagatgaggggttcagcttatgatcaatgcagaacacatctgttgcctctctctacaaagggactggggtacggacgtcagatctaaagtcacaatcaatgtactgcactgctccacctgtaggatgtttctgccccacttactctaggagacacaccatctgagcctcggtgataatacaagcacctggactatcgcaagtgcagggttaggactactcacttgagtgtggtgagttctgtaagggatggctgagtagccttgagatagctttctctccgcgcagcaacttttggagaaggcttaggactcgtgtctgagtctccactgtcttcatcccccatggccttgatataactgccactccgcattcttcggcatggaatttcatcatctttacctcgtggggtgtaccctgtccattcatcttgtggaacctattcagatagaaaacagataaatcactttttataaaagcctacctttttcttttctttttctttttttttagatttaacatttctattttttttttttttttttgagatggggtcttgctttgtcgcccagactggagtgcagtggtgcaatcttggctcactgcaagctctgcttcctgggttcatgccgttctcctgcctcagcctcctgagtagctgggactacaggcacctgccaccacgcctggctaattatttgtattttcagtagagacggggtttcaccgtgttagccaggatggtcttaatctcctgacctcgtgatctgcccgcctcggcctcccaaagtgctgggattacaggctaacatttctaatttttatgagtacgtagtaagtgtatatatttatagagtacatgagctattttgatacaagcatacgatgtgtaataatcacatcagggtaaatggggtatccatcacctcaagcatttgtcatttctttgtgttacaaacattccaattatcgtcttagttatttaaaaatgtataaataagaccaagtattttctttttttggtatggtgctggatattggtaatataattatctgaaactttagacattaacctttcaataacaatattttattgtaataggctcataaatattttgaatatgtacaaatccacgtctctcagtctttaacatgactcatgtagtaggaaaaattaaaaccattggctttgaatcatttgtacatctcagttttctcatgctgataatagttgagtcaggcataagaatgccatttgaaaggagagcaattttatttgagcttttcagtgatttgttttcaattgccatttaagattcgggaatgtttactgattgatctatgccttccttgaacctttcgactttaccatctcatatccagtctgtcttcttcctaaaccagtggtctctaccagctgcatttactccccagtcacttattctttctgaatctttcttaatttggattcagcttccttagatctgcttaaagcactctctaaaggtttccaatgatctcctaatggaagataatggcattttcttgcttttattttttcttggcctctgcacacccgtgcacacacatacacacaaataacacctctttgcaagtttctccccttttggccttctgattgcttgacttacctggtgtagctactacttgtctgaattgttcctttccttttgctttgctggatcctactctaagtccctaactgtggataccacaacaaaatcatattgtcagtgcactgctcttcttttttctttccacagtcattttttctgagttcagcagagcactgcactacgttttagaagccatcttcatgactttctcttcagttcctcttagattttccacttcaacatgaactcaacctagatctcattccttcttcatttttcatgacgtgaaaaaaaatgcataataaccactctttttattcattaagaagtaacatagcaaacatactatagtggacagagcactgcacaaggcttaagtaaaagagaccaaaaaacggggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcatttattaattatgctagtaacaatgtaatgtttttacttttgtaggtaaaagcatcaaaatcaccacagcaacaaagatttctcaggaaattataaatgctgagaacagtcttgttttccttgcattggcaggtgactcactgcatagatatgatcatcttcagagcctcattataggtttagcaattacattttaaaaattaacttggtacagctgagggtcatagatgacgcacaccacacttgctatttctcaatcctgatgtgaagttcataagcattgctctctggagtatgtcagagactaatgacaaactgattagctcatatggcttatgcaacaaaacatggcaaattttgttcagatatttttttcaaagttagtttatggtagaaatttgggctcatactagaaacagtctgtaactgttgtttagggaaccagctgagaagtatttaacctgtgtatctttcaattaatcttacttttcaaatgatagcagctaagaagttatgtggaagtgacttccattggagtggaatttgaatagtaatacattatttatatacctaaaggtagcatacaacaagattacacataaaataatacagtaatccgttctagggaaagtgtaaagacagaaaatcgagaccttggagaagaaaaacacaactgctgaactgtaagggccattaacatcgatataatcgagtcagtttttagtttttgtttcttaaaccctaaagcaaaagggagacattgcttaggtagatagttttagaagaaagcatataaagtgataagcataccaggcccaaagagtgaaatgttactgccttttgattgtaaagaaagggagaattacatggctgcagctgctattgtgagctgggcagaggttgctgtgtctttccatttcagctgcacagagagaaaagatttaggaaaatccaaagaaaaagataaccttgcagctgtctctgaaaagcctgcgttattactgtggtggcagtttcaggagctggaagtcttggtagaaggaaagctggagcagagacaaagagtgcaggtcctcattgatttcaggctggtgggatgccctgcttgtgtgcaccagcttaggagggggttggactcaacaaacataaacaaataataataaaagcaaactaatacaggttagattttatagtagttatggatgagaaaaaaggattaattgctttttaattattatgtttaagcattagcactccaacagagatcttaatttttgatgaaacaaaatgaggattagtgtgcattgtctatttcagtggtagcccgtctataactgaaaccatatgttatcattcagaaaactggaagacctgcccttgactaagaaatggccataatcaagtgctaacatcctctaattacaggatagggatgtagggatggtttttttttttttttttttttttttttttttgagacagggtcttgctctgttgcctgagctggagtgcagtggcgtgatcttagctcactgcaacctccacctcccaggttcaagcgattctcttgcctcagcttcttgagtagctagaattataggcctgtgccaccatgcccagctactttttgtattgctagtagagacaggattttgccatgttggccaggctgctcttgaacatattgaaagaactatttcaatacctttttttttttgaggtggtgtctcgctctgtcaccaagactggagtgcagtggcacgatcttagctcactgcaacccctgcctcctgggttcaagagattctcctgcctccctagtagatgggactacagatgcccgccaccatgcctggctaatttttgtatttttagtaggattggggttttgccatgttggccaggctggtctcaaactcctgacctcatgatctgcctgcctcggcctcccaaagtgctgggattacaggggtgagccaccgtgcccagccaggatgagaatgctttctgaattgaaatgatgtcactgcactgaaggatgggctctgctggaagtggagtatcttttggtgctgacatttccccccactttaggttttcctaaactcagttgaaagaggaacacacggccggacgcggtggctcatgcctgtaattccagcactttgggaggccgagacgggcagatcatgaggcaaggagttcaagtccagcctggccaacatataaaaccccgtctctactaaaaatacaaaaaattagccaggcgtgatggtgggtgcctgtaatcccagctattcaggaggctgaagcaggagaatcgcttgaacctgggaggcggaggttgcagtgagctgagatcgtgccactgcgcattttactgaatctaagatactaatgcaattgtcccaacattttttgtgtcactaagaaagaaataaacatcatcaataaattctgacactccatagaatatataatttatcccaatatccaaaatgctaaaacgtgtaaactatggctcttagaatcaattaaaaaccttttaaaaatatgtatgagaagaaaaacaagaaatgaatttattctgggatagtaattgttgaacttaatgttcatatttagtaatgaccaaattaatataagcaattacatttatcatgtcatgagtttggaaaaaaacataagttcacataatgtcttatgatccttacaactatcatgaaggatatgaagagtaaatattataacctcagtttgtcaaatagagaaactgaggtcaggagagattagtaactagtgtagggtgacactgcccaagctgaggtctgccattcacagttcaggaatctcccccgcccccttctagcatattcatatatgtcttttgacatgtcttttgggtaacaattgttattttttgataaactacaaagcacatattttagataagaaaataatatcatagtgttttaaggtctgtttgaaggaaaaaattaataaacaaatagtgggttacaaccctttgaaagaaaagttacaagaactactctatcagatgtaggaacgcttagttttaaaagtctctccccaagggcatctagcttgagtgccccactttggctgggctgcagttatcaaagtgtagctaaatagattacagtctgtgccaatgatggtctgtgagacgatgattgagagatgaagccatgtgcacgtgactctttgagagcggattatctcaggatgggaagttgcatggtgaggtgtggagtaatgagaatgcgtgagattttgggaaatctgagagccacaaaaggaatgaagacacttagaaagccgggacagctgaaatgaagcatatgtcctgaaaatatacaagggcaggcctgtgcgattctgtgagctattctgggttgcagagatttgggaggaaaactgatgaacccaaggctgtgagtacataaagcaaagttctatttcatcaggaaccaaagaactgggaggaaggaacctaggcatttggttgatttggtgaaaacaaaggcagtagagcaaggaaaagtagcaattgaatggtgggcatgagggataggcttctatttgcacagttacccctcagcagctgttgattccttcccaagcacaaggtatttcaatgacagcagccaggtaaataagggtgcttggcagtgacttagggatcaacctgtttgactttcctgtgcttgaaaaggaatggtaaataggaggagaaaaatgtacattatgaaaggagagttgggcatctgacattcatgaaaaaatctgacaattatggaataatctcaatgagctaggggcagtgcctatgttactttatgttaatctttgcagcagttgtatagaataggcattactatttccatcttactgcttcaaaattgagattcaaaaaggagagttaggcatctgacattcatgaaaaaatctgacaattatggaataatctcaatgagctaggggcagtgcctatgttactttattttaatctttgcaacagttgtatgaaataggcattactatttccatcttactgcttcaaaattgagattcaaaaaggtaaaatgcaatggctcatgcctgtaatcctagcactttgggaggccaaggcaggaggatcacttgattccaggagtttgagaccggcctaggcaacatagcaagaccccatctctacaaaataattttttaaatgtagctggtgtggtggtggtatgtgcctatagtcctagctatttgggaggctgagacaagaggattgcttgagcccaagagtttgaggctgcagtgagctatgatggtgccaccactctccagctggccgacagagtgagactctgtgtcaaaaaaaaaaaaaaaaaaaaaaaaagatgaaacgacttgcccaaggtcataataattggtagaaatgtgcatttgtctgacatcaaagcttttaataatattaccttgcctctgatgaatccgtgatgattaagtgaatgaaccaataaactaaaaaaaagaagaagagaatggggtgcacgctcccactcaacagtcgtggtttttaaaataaaatgtaaccattcaaataagcataaacgttctcgtgtcactaattttctagcactgctaaaagagggttcaaaataataaacacttaattctgaagtgaaagagtgttgttgtttcctggtctggggctgccttaccaagtattgtttgcagctgctgtttaaacaagcatgaacagtttggaggagggagtgggtgattagaaaacttgcaggacagccacacctttaagggtggcttgggagccttgaagcatcccaacagcgttttagcatttgtaagaaggctccaccctggactttaggttcctgcctacaactttttagagaaatggctgtaatgtgttggccttctaagcacttttagtgggctctcagattccctactcactcgatttctttgcatcttctttgcagctgggagaactgcttttctgctccacacagctttcaccttgacaaatgcgacttggcttaaatgtccctttagcctttttagcttgctcttctcatagcaaaaacagaaaaaaaaaaaaaaaagagcaagaataggaaaattacaattatgcaatgtgcagatccctaggcatgattgttgcttcccaatcaggagaagatttccctggcaaccgccctttcttactcccctggaagcccgaaattggtggaaaacttaatttgttttagattgcttaaaattaccttttaaggataagagtaaatacctacctctttaaatagaatttataccctttgtcacagctcttccaaataacatttttaaatgatcttgaaagaatagaacattgtaaacagtgatacatacggtaatttgcttaccatgaccctgtagaattattcttacccacaaacatttacagtatctgcagggtacccagcaccatagcaggggctgggtaaatacaccaaaagcattttataaaacacagtctctggtgttaaaggagtttataagttttgagtggatctggtgaatctggagggtggaggaaggaaacgagtaaagagcagctttaagtaagtcaagctgagtcgagtattaaatctcagtacctctgaatttcctactgggtttgaagcttgttcccataaatcccctttcctggtgatgaaactgttccttaaaaattgaacatatgtgtgtgaagtgcaaatgccactgataaatagccctgcaggggaatggcagagggcctaggtctgcagtccccaagggattggggagccatgggcctttggggactagtagaaaatgttactgaggtgctggatgacatcaaaaggggcactaactgtggataagacactctcgtgatatcacatcaagaaataataactaagatgctgggtgtggtagaatgcacctgtagtcccagctacttgggaggctgaggtgagaggatcacttgaatccaggagttcaagaccagcctgggcaacacagtgagacaagatattaagattctagtatgatgtagggacaggaagggaaatgaattttattaattattcacccactattttgacggtagtgaatacgtataggtttagctatcccagttccacttctggttcttgtagccaagcctcctgattttgctttgggaaaagctttctcctcaattcgaggtccatgtatttcaggagtagcccaagagttggggtaggacaatcagcaaatcacacttcctggcttcattgcttggctcagggcagaggtgaatgatctaagcttactcagtcagcaagcatctctggacctgtgcatgaaatgccaggacaaagatacctcctctctcactgaatatattaatagggatgcatgtgaccttaggacttgtcggtagccattttataacatctaatacacaaacataatttcacgtaatacaaaaaccttatgttatcttaatgccattgcaatgatgaaaaaattgagacttagtggtattaaataacttagaccaaatgttacagcttgtcagaattgaaagacaggtttgtcttactcaaatttctacactcttcttcacaccaggctgctgtctataagagtttcaaaactttgttatagtaattttctattaaacctaaaattcaagtgttaagttgctgagagatacaatcccatagcattttggaacttgtaacaagtactgagtgttagatgcttggcccagcactttgggaggccgaggcgggcagatcacctgaggtcaggagtttgagaccagcctggccaacatggtaaaaccctgtctatactaaaaatagaaaaattagccaggcttggtggctggcacctgtaatcccagctactcaggaggctgaggcaggagaattgcttgaacctgggaggtggaggttgcaatgagccaagatggtaccattacattccagcctgggtgacagagtgagactccctctcaaaaaaaaaaaaaaaaaaaaaaaaaaaaatagaggtctaggtctatggtaaatatattttttccactgactatataggagataagctaacttagagcccctttttagtttttaagataacttcattttctggtgtattggaggcatatctgttggcttggaattgttagttgagccatcatagctttccattattgttatagttactagtgtgctggtgtctatccaccatatcctatgatgtttgtggctataattcctagttgcaaacattgaattccctgaggcaaactagaattttgtgtctggtgttcagaagcagagatgtgggtagaagattagtgaccttcctcttgctgccaatagaagcccacatgtggaaacatcattcatcaacactaatccttggtgttgtctaaaatcacataaacctctcagcacatctgtctgttgctatacacacccaactacttgtcaaacttgtatattaattttttccttaggacacaaaatctgataatgttattattaacaaatagtatagctagagtctataaaatatcaagtcaatcatctcaagtattaatacttaattttaaaattaaaaattttaaaaaaggtttcggcaaatattttcctttagtctattatcaattttgaaatattaagtttcttaaatgaggcttacttgtgaatcattaacttacatatttgacatttataaacaaagaaaaatctcaatagatttaagaagagacacaactcagagcctcctgcttctcgtcatcatcatctgattcccactgcatcttggggctgtttggactttttattccaagctacatttataacacctgaaagcatacggcattcaaacgggccaaaataatctttccttcctgaatcccatccattctaatgcaatgaaaccgtcaaaccacatgcatctagttcttgagatcgggaaaataactgaataatattttggtgtcctcatgcacatgtgtgattcaaaattccactttcataatcatcatacagggaagttgcctcttgagggtgtgtactttaagctacgtttcaatctactttccacaggcagcaagatatctataatgaacagaggatgtcccacaaacatgtgtacagatgagtatgatacactcaatagttatccaaatcagtgcttccaggctagctcaaggtccattgaaaggaaatgttccaactggagtattcattacagggttctcttctttcactttaaactgattactttgtggttaagctggagttaaaagttccacttcttctgtgactttatcaaaatgctttagaagtattcattcacttgttcaacacatatttattgagtatatacagtcatcctatggtatctgtgggggactggttccaggataccaaaatccgtggatgcttaacttcctgatataaaatggtgtagtatttgcatataacctatgcattatcttcccatatactttaaatcatctctacattccttgtaataccaaatacaatgcctgcacatcacttcatttgtgtggattcaacatagtactcagggttcagcaaattcaagttttgttttgtgcaattttgtggattttttttccaaatatttttgacccatggttggttaaatccacagatgcagaactgatggatacatagagaggactgtatcatgaaacaggtgctattttaggtactggggataccgcaattcacaggcagagaaaaaaatctccgttcctcaaagaactaaaaatagaactaccatttgacccagcaatcatagtactgagtatatataggaaaataaagcactctaccaaaaatacacctgcactcacatgttgatcacagccctattaaactatactaaagtcatggaatcaacctaggtgctcatcaatcgtaggttggataaagaaaatgtggtacatatacactatggaatactatgcagccataaaaaaagaacaaaatcatgtcctttgcagcaacacaaatgcagctggaagccattatcctaaatgaattcatgcagaaacggaaaaccaaatactgcctgttctcacttgtaagtgggagctaaacgatgactacacacagacataaagatggcaacagtagacactgaggactccaaaagaggggatggtgaagggcaagggttgaaaaactatctactgagtactatgttcattatttggatgatgagttcaatagaagcccaaatctcagtgttatgcaatctatccacgtaacaagcctgcacatgtatgccctgaatctaaagttaaaaaataaagctctgctgtcatgaggaagggaaaggacagacactaataaaatgggcaaaatgtatgttaggcaatgatacgtactatggaaaaatgaaagcaggaaagggggaagactgtgtggaggagaggtgggtggtgggataggcatgttaatagtggcatcatcgcaggctacattaagagacctctaggtaccgactgactggagtcagggactctgccctggggtctggtggcagagtgctcaaggcacaaagaagcacagatgagaaagtcctgaagaaagggcaggactgccatgcacacagcgggaggccaggtgagtggagtggagtgagaggtggcagaaggtgaggacagtgatttggggagtgtgggggtccatttcaggaggctttacaggctgtggtaagggctgtggcatgtacttggggtgagatgggagtagaatggaggctttgatgagatacagacacattctagttcaagagaatcacgcaggttgctaagttgagaatggctcaagggcaacaagagtagaatcagagacccttggaggctcatgcaataacctagattgtagctaaaggggaggagccagggcagagcagcggtggagggagaagatagggccaagaggtttgctaacgatgatctggatgtgtggactgagaaacagtagttaagggcgactccaaggtttttgacctgatcagctggaaggactgaattcccattagctgagatgacaaggcctaaagaaggagtagactcaggatggaaattaggagttcagtttgggatgtaggaagtttgaaatgcccatgggtcatctaagcagagatgttgaatagggtagcttactatctaagactggggcttcagggtggctgcaaacatccctgtgggcatacacctgggacttagagctctgagaatgaaggaggtgacctaaggagtgagtgttggtagaagagagaaatggtccaagagccatgtccactcagcattgctccacccttagaagtttggagctaagaaaccacaaactaggcaggcttaaaacgatcaacaaagggtgtgttgtcggtcctggaagctgagtgaaaaaagtttttcaaagagaaaggagtaacgtactgtcacattgacttcttcccgtgatcttaatcccatgggacactaagtcagcaacgttaattttatctcttagtctcagttgccatagacaaaggattctgctgttcatgaatagctttatcttcccagcaagatgcaaacttcttgagagcaaggcttttgttttcttctttttctctctctctctacagcagtggcttttaaatagcttttggctacatctcacagcaagaaatacatcttactttggaaaccagtataagcacgtatacaagtgaaagacagagagaaatacttaaccttttggcatgccacacactgtctttattttcattctcttctgttgtattctatttaattaaaaataatggtgtttgtgacccattaaattgatttcactaccactaattagttgctaccattgcttagaaaagcactactgttagagtgtctgccacagtgctctgccacattcattattaatcagagagacactgttattcatcttcattccttctcaagtaccttctataaagcaagtacttaatagatgcttgccaaatgaatagttttgagaccctaaagtaatacttcttgaattgggctccttggtctttagttacctttacttttactgattgtacttctgtactgattgtagtcgtgtagaagaatatttcttaaaacctctgtgtcttcagaataaacacagacctgcatgtctttttaaagaggtccctgtgtagccaagagtcagacaaaacaccagccagggttggagatgacagcccagatgaagtgagtccatcatctgggttatcacatgtgcaaagttagggcaagaatcctgaagtttgaatgctttttcatgttcttgtacatcagcctctgggggccaggggcagtggtgttcaaaacatttttaaaaacaagacaggccaggcacagtggctcacgcctgtaatcccaacacgttgggaggctgaggcgggaggcttgcttgagcccaggtgtttgagatcagcctgggcaacagagcaagacctcatttcaacaaactatttaaatattagttgggtgtggaggcatgtgcctgtagtcctagctacttgggaggctgaggtgagaggatctcctgagcctaggagctgaaggctccagtgagttgtgatcaggccactgcactccagcctgggtgacagagcaagactctatctcaaaaaaaaaaaaaaaaaaaaaaaaggacaaaaagacaaaacaaaacctttaaaaaaaaaactttcaagaacaatcccatctttttattataatttacatagtattcaatgtcaatatgaaatattgattatttaaaaatgggagtagaaatctttcattaaatatctatgacccaaagtcgatggagctgggaaaatcattagtactaacaatgtcttagaattttgaaatgcccaactacagaaatgatatataatttaacccagacatttcatttaaagaatctttaaaataagagccaggtacatggtaaagtcctcaataaatgttagctaatgtttaaatccttctctatagagaatgcttataaaagtggcactgaagaaaataaaatatttttccaccatgtaattcttacttaggtagtttttcacttataaggaaggaggatggtgcaatgaatacagtacatcaggtcaacctgagttcaaatctgactctacttagaccagacatgtgattttggcctaattacctgaacatcttttaacttcaggttttcaaacataaagtgaggacagcaatacctacttcagagactgactataaagatagagatgatataaagtaacatatgacatgctaactcattcaaagtgtatttgtaggttgctttttcatatagtaatcatgtttaaataacggttaagttcccacatggtgcaaacccttaaagcttgtttcattcatgatagagctgacccttaatggattgtgcaatagatccaagactctctgagcttgggggtgggagggggtggagggtggggaaggttagtacacttgggggaatctctagaggcctgtgtataggggactgtggatcagtcagggttctcagaagagaacaggaaaaaaaaagatttattttagagatgactgtggtgagtagcaagtctgaaatccacagggtggtctggcaggctggaaactcaggctggagttgattctgcagtcttgagacagaatcttgtcaataaaacctcaatttttggtcataaggcctttcaactgattggttgaggcccatccacattatggagggtaatcttctttacataaagtctactgattatagattttaaccacgtgtatacaattactttactgcaacacctagattagggtttgattgggcactgggtactctaaactcagcaggtggctgcacagaactaaccatatagacaggaattcgggtgggcagcttctgaggcagtgggagggagacttgatgggcagacagggccgctgcagtgcttattgatattcagattctcttcagctgtgagctgcatatgctccgttcattttctgaggaactatggtttgggtcaaagacgtgagtgtaaagaccatctcctcactggttgttcaggagacccacaaaggccatgtaagcaaagtgagactcttactggctctgtaccagcacctagcaaggtgcctggcatgtcaatttcattgacaatgttctttaagggcaaaagagtcattcatggaatttttatttcttgttgacaaatgaacaggaaaatctacagtcacctgaaacatcccaccatggtaaataaacaggaaattggccaggcgtggtggctcacacctgtaatcccagcactttgggaggctgaggtgggcggatcacgatgtcaggagttcaagaccagcctggctaacatggtgaaaccccatctctattaaagatacaaaaaattagccgggtgtggtggcacatgcctgcaatcccagctactcgggaggctgggggcagaagaataccttgaacccgggaggcggaggttgcagggagccgagatcttgccattgcactccagcctgggaaccagggcaagactctgtctcaaaaataaataaataaacaggaaatttatagactcatcttttatttaagccctttgtattctgaaagacaaagaattccataatgcccggccttgataaaacaaatatagagctaaccttaaaaaaatcaagatttactgtagcaacttgcacatactactaatgtaacactgatcacattgttttaaaaccatttgtttatagatcagtctcacccaccaatctgtaagcaacttgagaggagggatgatgtcatttgtctggcagagaccaatattcattcctataattctagttctaagcagagtataaaagaaaacaacatattgtaaagtaaaagtgctcatgaaatctctaattacatcactcaggttgtacctattttattcaactgagaaataaagtatggacacctttcatcccagattttcctctaccaagggcagggaagaaacctcgcaatggttgtgggcaaacagggatcatggaggaacacatctccgtgcacgaagttgctggtgcatgtgtgtagagggggtatgaatgaccagtatccagaagagaggctcttttggcatccaaggagctgcagttggatgttgctgtggagatatttggggaagcaaggccacaacccccagcagggtcaactgaactctactaggcccagagagacccatcaccagatcatggcaggacgagtcaaacagaatctgaagactgtcatctcaccctgtgtattccaaagcacattttatggatcaccaatccttttttttttaatactttaagttctgtgatgcatgtgcagaacatgcaggtttgttggatcaccagtccttagaaatgttctgtgaaatgtggttccaagagggtttgggagatgctttatactgtattgttctcttaaagagtttccatccatatgagcatcttaaagattctaggatgtctgccaatatagaattctgaatacagtactcagtttctcaaattcaactccttttcttcacattaatatctattcaaatcatcctttgggaaatgtcagcttcttcacatacaaacaaagaaattgacatccagaatgtaaattacagcttatatggctaataagtggcagaactgggttagaattcagatctcctttggcccattgcactttcccagttcatcacactgcaactatttatctcaccactgaactcttcatgaatacctttcaacaaattctgtgaaactgttttgatctccctatatcaacatgtagaagacaaacatgaaggaatggctactgtgtataggagggactcagcctttggaaacttcatattttgtgtcaagcctgtgccaggatatgtttcattcaagttatcagtgcaaatgagaggtggtaatagagacatgtaagtgacatggatctatacaaataggtttgggtcacatcttgtattttacaccaagaacctagatcatgccaaccttttgatggtaaaaactgtaatgagagaagaatgcttcgtcaagataataaatgattacctttgcatatagaaataaccagaacccatgcatgcacactccattattccttctgtctcccgacattgactggaattcagtctttagtatcctctctctgtcacacacacatgaacgcacaagcacacttcatattcagtgatgatgtttttcctattacaaaaactgtgaactacccatggacagtaataatgcagatatatttcatttgagaaaggctttcttttgtcattttctttctttacctttttggtgatgagtcaagctgacctgctgggtgagatggttcagatattcatgcttcctcctagtaacgatgctggctttctgcaattcaaatgacccactacagctgcacgagtaggcacttagccacctactccagttagtaattattcgtttagactaaaaaattctgaatcaatagaaaaacattgaattaagcctcatttttgatatctcatttgacaaaggaatcatgttatttttccttgcagtggatttagataaacatccagaaaaaaaaaatgttttgtgttggaacggccacagagaaccttctttttttttttttcccaggagggaacataattctaagtcaggaaaaataatttatgtggcttcctagtttctgcccaaaccagccatatgctctcaatattactggaagaagtctgaaacagaaaatacaaagtaggggcaagaaggcccttgtgggggatgcaggggtggaaaacgggaggcagcttaggtgccccccccatcactgaggcagaggagtgagagcacctttctcctttgtacacccacttgtctgtcaactttcctccttccatttgaggctgctcctggatgtaaattttgacctgctttcagttgtaataaatacatgaggcatagaagtaagagaagctcaaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacaggcacatgccaccacgcccagttaatttttgtatttttggtagagatggggttttgccatgttgcccaggcttgtctcaaactcctgaccctcaagtgatctgcccgcctcagcctcccaaagtgctgggattacaggtgtgagccaccgcatctggactgttttgttttgatttactaaacagcttttatttttctcttctgttacacagaaacaaacaaaaagataattattttgtttgggaggcatttgggtatcatgaaatatttaaatcagagatttctagcacgtgtgatcaatgaaaatagagggaaactaggacttctgaactgatttccttttggagcattctcatagatgaatctacaaggatacaatgatttgtctgaatgataaatttacctgaataatttatctgaatgataaaattttgatacctttattaagatacttgaaggtgttggtttacaaaagattaagtaccacagtgtaaaaattctattgttgcattaatttgattagcaatgaaaaactcagaatccatttctaaagaagttgataatacaaataaaacatttacctaaagactgactatacacaaataatttctgcaatttatccaactcataaattggtatagagatttatgggccgggcgtggtggttcacacctgtgatcccagcactttgggaggccgaggcgggtggatcatgaggtcaggagatccagactatcctggctaacacggtgaaactccgtctctactaaaaatacaaaaaattagccgggtgtggtggcgggcacctgtagtcccagctactcaggaggctgaggcaggagactggcgtgaacccaggaggcggagcttgcagtgagccgagatcgcgccactgcactccagcctgggagatagagcaagactctgtctcaaaaaaaaaaaaaaaaaaaaaaaaagatttatgtaatagatgattaatcatagcactggttgtaaaagcaaaatgcatggtagtgaatactgttccccaatatgtattgctaatatactagttctttaacatgtgatgttaatatagtacaaagtagcttcattaaagaaagagttttgatttgattcaatcctgtgttcccggtgtctggaagtgagcttggcacacagtagatgagcattaaacatttgccaaatgaatggacactccatataatcaaatatatgtacataggtgaatgtgtacgtacacatatacatatttgtatgtttgactatatgtagaaaatagcagaaggcgaatgttaaaatggtaacagtgatggctgcctttggttaaataagactggaacacggtgggggagggagcttttacttttaaccctgtatcaatctgtactatttgaatttttttcacaattagcatatgtaacttttattaaaaaatgaattctgtgaaagaaccccaaatgtacgaccactggagatctgcattttagaatttgtgttgtctttacattatctcaccttaaagatacaactccattatgtacacgataacctaaggaacaggctttgactggaaattgatgaaacttggaccacagaatcagaaattagaatcttcaaagaatcgtcattacagattatattttgcttttccatttcttcagcttcaaccagaattttatattcaaagttaagaaaatttacatgtaactgtatgcaaaaacccatatggcctgtgtcagtctgtaccacttattttcaatgagataaaatagcttatttaaactttgaattttcccattgggtttagatgatttagctgtttatccagcagccctatacttaaaaatagatgagatgacatttgtgggttctttaaaaaaataccctttggagaaagaagcagaacactaatgccatatttaccatttacattatataagaatggcaagtttttatagaatgagtgcttcatagaaaatatcctcctttctggccaggcgtggtggctcacgcctgtaatcccagcactttgggaggctgagggggcagatcatgaagtcaggagatcaagaccatcctgggtaacacggtgaaaccctgtctctactaaaaacacaaaaaattagctgggcgtggtggcgcgcgactgtagttccagctacttgggaggctgaggcaggagaatcgcttgaatctgggaagtggaagttgcggtgagccaagatcgcgtcattgcactccagtgtggcaacagagcaaggctccgtctcaaaaaaaaaaaaaaaaagaaaatatcctcctttctaacataaaagctatagctcttctgtaaccagtcacaatcattgcatatatgagggcatcccacataagtttcattatttgatgattataattaatttaatggaaacataaacatggttggaaagtttccaataatagcataggaagatttttctctcccttctcccttccaattatgtagtgcctccccgccatcgccatcattcttttatcaattatttattgtgtgtctgctatgtgggaggcacagttgttataaaacaaatataaagttgatgttgactatatttaacttgaccttatatacctatttaataattatagcaacctgccaaaaatgagaagtgattaatattagccctaaacctgctgtcatacgattccacagagttcaagataagaattaacataagttaagctgaaaatatactgtcacctgaaattgcaaactgggtaggtatacaggagaacgatagtcaattaaagtatgaaatattcaaatcagtgttccaatcttggtagcattgctgatggcaaaggatgatgacaccaggaggaaatgaaagcaaacacatcactttcctactcagaatagtacacctatcttaggatcttactgattttatttattaaaaaaatacactttaggagaaaagtgcatttatcgggtaatatgaaagaggaaatgaggtctgtgtgagggcatgggtatatgccatcactatgcaacattttaatcttcagtttttataggagtttcctctgagcactcatcaaaggtaatgggattagattttttttcttcctttgtcaaatgttttcctcaccctgaatactgtcacacacgtcgcaggtggatgagatttgtccactgaggaggaattgcacttttcgaccctcctaggatgtgacttgaatacctggcttgttccatgttgggcttgccacctgctcctgctctgaggtagccgctgacctaaaggcatcgcaagggtggtgaggtgaagagggagcaagtgttctcagccacacatttttccatctcccctcagaatccacctctcagaggtagcctaagtggccctcctaccggatgcgttgttttatcacgactgcagctttcttttcttagattctgccaatgcttttaatgggctggtcccctgcgaagagcagggattttgtgttttcttttgaagagcgtggtagatttctgagcaccctgtggcagtctgtaaaagtgataaatacaaatgatgaacaatgaagcaggctcttgagttctggggctggctacaggagaactcagaacgagggaaaaaaataaatcaatttctaacacaaaggcaagatttagcctctcattagatccaactgctacatgtaaagaagtttgttaagaaaatggcacagggattttgtgaggtggagccaagcctgcgaaataggctttcaagatgtgttttctatcttccttccaattttgggtgctatgatgtaacaggattttgaaatccaagcatatgttattttctttcttcttttccttttatgtttaaacctccattatgatgaattagctttccttcctcaataatttagagtttattttctataaaaaggaagcatttagaaatgtgatattaggcatatggccccctttcagatccttccagttctatttgtatatggttttagactcagctgtaaatatattaatttatgcagcaatggatattataaatcctacactttatatagatgtaggctctttcttttcataaacaaaacttgaaacaatactaaatttttaaaaagatagacataattgataatttcactttgagaaagcaaagtaacccagattgtaaatgttatggacaaaggctgggcgcagtggctcatgcctgtaattctagcacttcgggaggccgaggttggtagattgcctgagctcgggagtttgagaccagcctgggcaacatggtgaaaccccgtctctactaaaaatacaaaaaaaattagctgggcgtggtggtgtgtgcctgtaaagccagctatttggggggctaaggcacgagaattgcttgaacctgggagacggaggttgcagtgagccaagatcaagccactgcactccagcctgggcgacagagtgagattctgtcaaaaaaaaaaaaaaaaaaaaaaaaaaaaaaaagtcagggacaaggataaatgcaaattgtacacatttctctctcttgattttatgatagtttggaaaagaaccattttttaaaaaccagtatattactaatggatggcatctaatgtcttagtaattaaaaaaaatatagattgggatggagccacagaattcaacaatggggagaagagagaaatagaaggcagagacaattttagaataatagtcaactgtctgtggaaaaaggggagcttcagttagtgaatgaaagaattgagttttcctgatgttttcatctaagattaccctcataccacatgcacagggcttgatcataaagtatttgaagttagtaaaaatgtaactagtccagttgagctaaggaaatatcaaaatgtcaattgttctttcccaagtttagtcaagctaatcagattctttcagttgttaagaaatattctgttgtatggtttatgtgtaaatatgactagaaattctcagcagtggtaaagcatcgtaactgggcatggttgctacacatatttgtatctctgatagtgcctggcattgtcccttgcatacacaaaaagttcaaaactacatgcttaaaagtgaaggatttcactctcccctgaaagcactctatttgatagagagcagcactcttttgtgcttacagcaatgagtaaactcttagagccaggttgtgaactgcttgttgtggatatatgctgtagacatttaatcacttgataactcattagtgatatatttaattcatctaagatgatttatgtttcaaatgtgaacatgatgctttaccattacttttactatttaataaaaagataattgttgcatccatttataaattttgcattaaacatgacacatttatcttttcaaagaaaataattgttaatcttagaaaattttcctcaaatgtgcaatacaccaggcaaaaaccaaactctggttttactgtacttgaaaataaattagcatgcatttcacatggtattttgttattctcctttcatagcctgctttggttaaaaaaaaatcatgtcataaaagagatggcaaattagatctgggagtgaagaaaacttgttcctaaattttatcttagatattgaactactaaatagatgataatgaaattaatgtctatttcatgcatgaagcagctctattacgtgcttttataatttcttgcttttgagaggttaaggtggaagggcttattttctttagacactgatcctgggattcatgaacttcattattctctttatcttatgataactatgcccacagggtacaattaatgaattaattcatcaatccactcattcacatttatcgaatgcttcctgtgtgccaagcactgtgcgagtagaaaccacaagaatcaataaaatcaatagacttatatttgtctctagggggtctactgtctattgggggacaggtagaattattggaggggagggagcaacaagccctcaaacttggtgtcagcaaagtgtgaaaatcactagaaaatccacacgtaggcattggtagcatgggagctagtttaaggaggttatacttgtcttgggacttgagtgatgggaaagactttggcaactgggcaaagagaagagaggagggcagtacagaagtgggaacagaaacatgagcacataaacaggcactatatatactcatgggaagcagcaagcttcacttcggacctagggcctctcagggtactgctagaaacagattctgttgaaggtattcagcttgtgctaatagtctgtacttgttttaaagacccaggaggtctttttcagaatgtattttcttgaacagcctctttctatcaccaacatggcactgagaacaatagaaaacagctccttttgtttctgggacacacctcctcttttctaagattcatgcctggttgcccagggaaattcctcaaaccagcctttattctgagctgatcactctcttctgaacaggacattccgccatctgctcagacaccctggctgtcagccccaccctgaatcaccaggcatcacctcccttctcaaggagacctcacttctctttatgtctaaagccccacaaatggctttactccttcaaaaccctctctttctagacttcctctagcgccagcgttgcaattcctctgaccacgtatttaggcacacatataatatttagagggcctctctactccacatttaaccctgtaatatcatcttttttatattaacatcttattcctctttatcagctcatttggagccatgtttcatttcccaaaatatcaccactatattcttttggctgttgcatcaaattaccataaacccagtggcttaaaaaatctcatatttaatctcttacagttgtggaggccagaagtccaaaatagtttcactgagctgaaaccaagatagcagagctgggcgtcctctggaggctcgaggggagaatccatttccctgccttttccccttgtcccatggtccctttctccatcttcacaaccaagagcaaagcatcttcaaatctctctccgcttccacggccacatagtctccctctgcttccttcttaaaagaacacttgtgattacatttagagcccacccagataatccaagacaatctcccaccttaagatccttaatgtaatcacatctgcaaagtcatcttttccacataaggtaacatcctcagtttcctgagattagagtgtggccccatctggagcctctattccactaactacgaccacccacactaacaccattgttaatcgagtacttactctgtgccaggcattattttatgataggcaccatcattatctccattttacagatgaagcagttgaggcacagaaagctttagtaatttagtaaagtcatatagacagagaagtggtagaaagagcattcaaatctaggtctgttcaactggaaagctgtcactcattcacggaacaccctgttgcctctcacattttccagctgactgtgtgcgtctgtgttctggtttgaattaaaggaacctaaaaactctcatggtcaacacaaaatggaaaatttcccagaaactgcacatgtctcttctctagctgtacttgtagatatttcttccacaaagagcatagctaattaactggttaagtggtaacaagtagcagtttgcttccccagtgaaataccagtggaagcccccctaagtagtctgacatcaggctacggttgaagaacatgaagggccaactgagttcaggcaaagtgctatggaaacagtaatcacagagcaggtccaggaaaataatgcctgtttaaaaggacaatggaaatgaaacagaaatgtaaggcccagctactttctctgtagagaaagtgagaaaggctgaaaactcctgtagacataaggcttgaagaagaaagcttgagaataaagaatacagcacaaagggaagtactttcagtttaatttaagggaaaaatacactcagggctgactattggagatcagaaggcaaatgaacactggcaggcagtgagaaattaaggatttaaaaaatgatccttatacatttttaagaataaactttttcttttattctaaggaggcagtaaatcacgtggaaaatagaaagaactggtccctggagtcaaacagactgagggtcccattccttaatatcagcatcatacatgacaacttgagcctcagttctttcatttacaaaatgggaacaacaacacgaagattaaggaaattatatgaaccaccttagcacagtactttgcaggaatgagtagcataaaaaatcattgcatctggtttctgcaacctcagcaagacaaaaggtaatacagcttgttaaagagtccagctagctactagtgcattcagagagaattcactctgtgccaggcatggtgctggatcacgggccacaactatgaataagagaccagctatgttctttcatgaaacgatctagtggaagagtcaaacaagaaaacaggcaatcctacctaagatagaagaagcatgataaggaaatgatgggtgctatgagagcatattgggagaggatacctcacttaaacttggccagtcagagaaggcttccaggaggaaacattatcttagatgagactggaaagttgggaagaggttaagtagggaagagaggagtttggcaggggtggggggtgaggggtggagggggttgtaggcaggcagaagagacaaaggaggaagcagctcatgcaaaggtcctgggcaagagaacatggcactgctaagaaagagaaaagcagaccagtatggctgaaatgcagagtggacagagggagtgttaggaaatgagattgtgaaggaaaaaggtccccagctacatcatactctctaagtcatgtttaaaagtttggactttatcccaagggtaaagaggaaccagtgaaggatttttaagcagaagatttaatgattttatctgtattttagaaagatcatttgggctataatgtgcaggatgaactggatttaggagaaactagaggcaggaagaccactaggagatatttacaatagtctagctgagaaatgatggaggtttaactgggatcgtggcaaaaggaatggcgagaagtggacagaaataagatttggtgtttttttttttttccactcattcattcattcaactaacttttatgagtctgccttagaggagagacacgagggtgagatagagagaggtatcaagattggccccatgtttcagcgttaaaaaaaagcatagatagtggtgccatttacaggggtaggaaacatggggtagcaggctcttgggaagatactgagtgcagtttttgacatgataggtttttgtgtcatgcctttatttttgtaacctcgatatctttgtgtaccccaacctgtgagaatagatgaggtcatattaacagtaataaccaagtccagtgatactttagttctctctcatctttgttcctcgcccagttaattctgattgtccacaaggatgagcttcacgtgtatttgggaacaaatctgtttgctgccttctgtcaggcctttttgcaatggtgccaagaacttcttatgactgtgggccatctgtactgatgctgctgcctcagtcaccactgtcctcagctggtacctgctctgtggcctttgatgtgtgtgtgtatatagggaaggtgggggtgcttctttctctagatattctctattaattaactaacacagagctaatatgtgagtttgtaaataacacatgccttgcatttggcattgctaaaaataccttcaagggctaacaactttgcatcttatctcccagcatgcatgggttgaccactacagacaaaagatcatgaagctgatgctggccaaagagccttgcacattttcaccctcaagttggttttatgtagcaattgcggataaaaagctctgctggtataaaaatcttcttattgtacaaatggcaggaaatagaagacaacattgcggtggttacaaaaatttgtttcctagtttgtttctgccagctttaaattgaacatagatcaatctataggttctgaattagtaatattggggagacatgaaatgagaaaaatagcagaattaaataagcataacagtgcacggggcagcccagcatgctctggagcgatgaggggtgagagagaaaggaagaaaagaagaaaacaaaatgaacacctttcaaatccaaaacaatgcaccacgtttgagcctccaatatagttttacaaagacagaatagccatgaaatcaaacatttaagtataaataggtaacatatgtctgtcttattgttgttaaaaattaactgtgatagactgaaattccattccacattcctacttcttgatgacttagtaaattacaggcatttcaagagaaatgcctaaaaattttaggtgaaccatcgacgatattttgggtggaagtaagttatatgtggtagctaaatacttgtgctcaagctctcagcatcctgtttatacttctaggaaagacatatgaaatgtgaacaatttcaaggaatgaaataaatgttcttctttatctataaaagtctgattgtggtgtttaaaggcttccatgaaacaaaaacacctgtgcccacagctcgtctcccgtgcataaaaacagaatacaaagatgagacagtaggaataggaggaacattttctatttctccaatatttcccacatgctttggctgtttttgaatagaccttctgaaatatcttttgaggtcacctactttgtgaacctaaagtctctgatttttcaggtgacatggcagcaagcccgaatgtctgaaaacataaatcttagttataatttccatttttgtcattttgctagaaaagaaaaatatgataatttcttccccagcttgctaagcctttgctagtttcaggaatttctgctaccatctgatgaaaatcaaaatccccgtattaaacaccaaaaagctatatcacaaaaaagtgaagccatcctagtaagtgcctcatcacttcttgtttttgagatagagtaaccaaggtagcaatagaagtctcagagagagctgatggtttctaattccataaacttagtggacaagtacattttccacatgaaccaaaatcattgccgccatggtgaatcaaaaaagtaataacaaaaattcacattaccagcacgctgttattttaaaaatccaattttacaaaataaaactcacctaaactgaagctgtggaataattttagcaattgaaaattactaccttctctagaataacatgtacttagaaatgaaatgattcagaaatcaacatgatgtacgtattctgcttttctttgcagcttagagcaaattcaacatcaatttacactatatcatagtaaatatattcaacaatcagtgcttaagtaatttagcctgtctttgctgcatctaaatattctgctgtttaactaaattcactccatactatagatgataaaaatattaatatacacatttcattcttattaaaaagctggatttctcccttagccctgcaagtaccataagcaaccaaatcagaggaaaagggtatgttggggctactctttataaaattgttcatccccagttcacagacatcatgaaacatgaaattaactccagtatgttaaaagaaagatgatagattagcacagaaatcaagcacaaagaaacgatttattttcctttccatagcccagaattgctattagcttaccttattagctggaatgccaaacagaatgtctttatggaaaattaagttcattattcatctcagctttgatttggtatagtgcagctgagagcatttagcttctctctatgatttgccgattctaagtggttgagtgaggcagtaaacacaggacttgggggtggggggagagtggttggtcatggctcacaactcaagatttgcaactttacattttcattcatataaagatacttaatgaaataaaaccctatagctgaagaataacacttaagtgaatacttagtgcagatttttcagcctgtgcaattttgcatagcagttgtacttacagagtctggcatgctcactgtcccagcaaaatcatattgctatctttcattatctcagtaaattctgggctattgatcactttgcagcccatatagggggtaacgtatattctgtcaaatggaagtccccatcagggaacgatccttgcagcttgctaaaagaagcatgcctgattgtctgactagtgatggaaagacagatgccttttacaatgttgaagtgtgcacatgcacaaattggatagaacattcagtcagctaacaaacagagagattttaaggagtaaaataacaatagatttccatccttgagatatcaaattctcttttagagaaaaattaagtaatacttctcaacaattcattcattttcttcaaaagaattaaacgtgttgtagaaacctcttggcaaacacttttcattttttaaaaaattgacttccatagagaaacatcccagaaaatcttattgaaagtgtggtgtgtgtgtgtgtgtgtgtgtgtgtgtgtgtgtgtgtctcatttcgggatggggcaaaggaactgttgcagcgtcctcttccaagtatttcactttataagttttaagtgggcagcatttactaaaatccagctttactgagtgcaatctgcaaccacatcagcaagatcacttttaggttatcaatagacaaggacaatacaatttcagtagagcaaagacttacacctttcctttcttcgtcaccatacaaaaccaaaccctaaaactttcctctactgaattaataaaagcacaggtgcatttaataagaaatgataaggaaaattataattaaatgattggtttgtttcaaagtgttaagtatagtgtcaccatatgacccagcaatcacgcttttaggcatataccaggagaaatgaaagcaaatgtccacacaaacacttgtacacaaatgttcacagcaccattattcacaatagtcaaaaagtggaaacaacccttgtatccactaactgatgaaaggattaaaagtgtagtatatccatacaataaaacattatttggaatgaaaagaaatgaaatattgatacctgctataacatggataaatcttaaaaatagtatgataattgaaagaggccagtctcaaaagatcacatattacaatattctatttatatgaaatgtccagaaaaggcagaatctatagggacagaaaagtagactagtggttgccctggacctggggtagggggaccaggaagtgattgctaacaggtacaggattccttattggagtgaagaaaatatttttatcttagatcttggtgatggttgcacaattgtgaacacattaaacccattaaattgtctactttaaatgggtaaataatatcacaataaaatttattttaacatgatgcattacattgatttgtgaatgttaaattaactttacatccctaagataacatttgcttgctcatgatatatgatcttttaaatatattgatgtattcaatttgttaaagggcttgcatgtctattttataaggaagctaggtcagtaaatttcttttcttgtaatatctttttcttgttttggtatcaggatagcattggcctaagaaaataaatcctgtttctgaaaaaaagagatgttataaaattattaatttgccaaaagaacgttgtcatatgtttataattatatgaatgagttttatataacacattctacacaaggcagatagggagaggttggggaagagaaaggatgaccccaaatgtgggatgctcttgaagactagaaggctgcagacgtatctcaagaaccacctgtgccggtgttttatcatggctaattttcagcaagaaaacaaatctccaaatctgcaagagtaagagcaccaggaaaaagaggaggactaggaagaagaggaagaagagaataaagatgaaggggaggaataaaagaaggaggaagaggaagacagaggagaataagatgagggggagagctgtgtttgatcaagagcatgaaagggcaggcaattcaggggaaggtaggatcaccaaacgtaattatagcaacatcctaccaaatgatccagacgagaataaaggaagcctagaaagaaaccaaaagaattgcacaatgagggttttgaagtattccaatgaaagaaacctgttttaaacatgagagatgggttcacaatcaagaaagaacacaggtaagtgataagtgcctacacaaagtgccccaaaagggctaaagcccagaatgaaatgaggtttgtgaattttaaaaagagacaagggccaggcacggtgtctcacttctgtaatcccaacattttgggaagctgagatgtttgagacctccctgggcaacagagtgggaccctgtctctacagaaaataaaaaaattaaccaggtaaaattagcatgcaagtagtcccagctgattaggaagctgaggtgggaggatcctttgagctcaggtgtttgaagctgcagtgagtcatgatcgtgccattgcactccagcctggatgatggagcaaggccccgtctcaaaaaaaaaaaaaaaaaaaaaaaaaaaaaaagccaaggacagtaaacacaaaaaagactttttaaaagagatggcttagaatgaatagaatgaggaaaatcccaaggcttgttccagatggtacaatgtgaacagatgataatgaaagaggaggaagaggaggaggagcagtagggaggagggaggagaaggacaaatatcaaactctcacacttttatttttctactattttctctatcagaggacatgatcttcaaattttaaaagggagaagacgcatggtaaagagaaatttgaactccagcaaaacctcttctatgcagatgactcatgcatttatatttttgttccagaactcccatgtgagagtcaggtacctgccaacttcacttagatacttcaaagtgctgcatacatagcaccttcaaaaccaaactctcccgcccccatctccaccccagcagtaaaagtactgggctcctgtagagttctgtacttcagtgaatggaacaactgtcttctacgcaggtcagaaacctgggtactctttttggacacttccctctcctgccatatcaccaagagatattgatttggaatctccggaaaccacccacttaccccaatatcactgtcaccatcctagtcccagtaaccattttcttgcacctggatattacatttgtcttctaaccgattctcctcttccactgtccttctccttccactccatccaaaaggatgttttcagagggcaaagtagatattagctttctttgctcctccccccaacactagcaaggatataaagattcaaatgttaaacgtgacctctggggccctgtgacatggtcctgcatctttccagacttatctagcactatcttggtgatccagccgtgctggattcatttctcacccttttgtttctttctgcctttgcaaacgctcttccctctactggaggcatgattcccttggctcattgtctgattaagtctagattttcttcagacctcatcccagtcttacttcatagggcatgctttgctgaacatctcaagtcaatatgcgattatctaatctcttctgtaggtattgagccaagtgatcatttgggatcaactttacttatgagcagaaggctcaaaaggtgcatgggtcactacactcttagtatcttcaaagagactcacctaaggttgagtctctttgttaaattcactgtggagagaactgactctctgctagccacccttctaataggatgagtatgaggggtgcattgcatggagggaggcaggaaataaacactttgagatcaaggacactacagaagatctcaggtactagatgcataggggagtgctaagaaataccaattccgcatgccctagactccatagggccctagtccagtggaaagttgaattctgctatcatttctcccaatgaagaaagggacagccctgattgcagacatttcactgccagagaaccagggcagagctcccagaatagttcaacagcagcccttaccatggtagtaaactgacattcatttgtgtgattgatttgagaatgtttatctcaccactgaacaatgggagcgcaagagcagcaatcatatatgtttctgatcatcttgttatcctttgcctctactcggggcctagtgatagtaggcatttaataaatatttttgaatgaatgaatgacagagctcttaaattgctaggctgtgctgagagggtaatgacagcattaactgcgattagcaaaacacttgaaaccaagtgttttatatagagtgttagtactagtggtcttgtttataaatctgacctttctatatctttctctggccaataacactgtgatgccattaaggcatgaagattcaatattagtcaaacacatacattctgcttagaaaattagcatgtgggatgttgaggccaggtgcagtggctcacgtctgtaatcccagcactttgggaggctgaggtgggcggatcacttcaagtcaggagttcaagagcagcctggccaacgtggtgaaactaacaagacaaaaattaaaatacaaaaatctctactaaaaatacaaaaattagccaggcattgtggtggctgcttgtaatcccagctactcgggaggctgaggcaggagaatcacttgaacctagtgaggcagaggttgcagtgagctgagattgtgtcactgcactctagtctgggtgacagagcaagactccatctcaaaaaaaaaattagcatgtgggatgtcgatttaaaatattataagatccattagatgaatgatttaattttcccaatgaagacatttttctttttaaaaagaggacacacctaaaaatattaagctcgaatttttgtgcttgacaaattataacacaaagaacttttggtagggcccccaaaatcaacctgggcattcttaaagattgttaaaagaaacggtggtggcaaaacactgaagatagacaagacttttgaagctttaaagaaatatgttctgtatatagtagcatgataggcttgactttatacctcagcatcatcctagaacaggctgttaaatggaaggtccgtgagtgcttaaagaagcaacccacatttacaaagaagtagtatgctaagctgactgtgctttatttttattttttatttttgaagattaacttggttgataggtaaacacacacactgagatttcttataaaaaatcatctttatagaaaaaaaacaggagaaaaagatttctaaatggtaacaggactggttttcacaggagctgaattttctcacttctcctggaatctattccaaacaacaaaacaacaatacaacaaaatgaaaagaaacacccacaaattacattttcagcaaaaccagcagaaaatccacagactccaaagtcagagtcaggcagaaagccaaggagaaaagtcttaatactgtggtaggtaagtgggaggtatgaaggggttctagatatagcagaactcagaaatctctgttgaatatccactccccaaaagtaagggccttaatccaagaggaaagtgctgcagaaaagactgaaatttacgcagcaggtggagggtaaatggcaaatctcattagggccaggaaaattctaaaagtgttactgaaagtgacggcatcatttgtgttcccatgtgacaggcagcctgtgaagtgatccatgaagtaattgaggaagaacagaactaggtttggttctgagtcagatgatgtgtgactatatagatggatcatattatgaagaaacaattgtagcagcagcaaaggaagcctttgatgcttggaaaactactgcccatcattccctctacaggaacattcttttgatttcctaggaaaattcaactcattcaaataggagtaatatacaagtaatacacatacagatatgataagaaatatggcctatgacatgaatttacctatataacaaacctgcacaatatcctgaacctaaaataaaagtttaaaagtaaaaaaataaaagaaacatgaagaagaccagtcaggaatttcttgtaaataatgaaaactcaactgaaatatatgttgtcacaaaaaagattaaaagcataacccaacattgttattaattaaaccaataattaatgaagcagttatagctataaaagaagatcacaaagcagagttgtaagaactcagggaagaaatgagaagaaaacaggaggttactggtacactgctggaggatgtcaaatgggaactggcggaattgaaggaaaggaaggtaaaggaagggacataaaagataaaaagtgaaaatgcaagtaaattatacagaggcaaaaaagataaagaaggattagagagaaaaggacatgtatcgaatatggcaaaggagagccatcatatgcatagctgtgatctcagaagaagaaagccaaaacaatggaatagaataattactttaaaatataattcaataaaacttttctaaaataaaaaagccttaaatctacttatgaaaaagatatccattgtatcagtgcaaagtcgtctagaatgatcaacccaaagacacatcccagaaaaatttttgaaaagaatccttaaggcagtcaaggaaaaagataaaaatcagttaaggaagagaaaatgaagttgacatcagatttatccacagaaatatctaacctcagcaaagagtggagcaggatccataagataccaagttagaaggcaggagtcaaagattttctctctaataacgctccccttcagtatcaagactcaaggaaaaaggcagctttgagcctgccaggatttgggtaacactgtttcctcatgttttctaggggaagatcctaaaggaggtgctatagactaacatgaatcaacagagaaatgtcggcaaaagaacctgtggccagtgtttaaatgatccaacatgacaggaagttcctgttggctacatatatataccctttaagaatttttttctattcccaatttgttataataatttttttgttagatcattaatggctgttgaatatttggaaataccttttctgcatatattgagacaatcctatgtgctttttatcctttaatctttaagcactgagagttatgtgaatatcttttccaaagttaacctttctttttgttaataaataattgtcatctggccatgttattttacattatttttaattatttaattgtatttttaagtttattaagaatttttatgtcagattcatgaaagaaattgcatttaaatttttctttcttaaatggcccttgtctggtttaagtctatattaaatcctgaaactagttgggcatttattttttgttgttgttgttgttctaatttctagaagaatttttatacgacagggattacctcttcttgcaggttttataaaaattaatagggtctggtctttttctgagtaaattttaaactaaaattttaaattttaatatgtcagtttcttaagttgttatggatatattcaaggtttctgtttttactgagttttgaatgctttatttttccaggaaactgaacacttacattttcaaggtacaggttgagtattccttatctgaaatgcttggaaccagaaaggttttgaatttcagattttttcggattttagaacacggtcatgggccaaacgacattttggtcaataatgattggatgtaagacagtagccccataagattataataccatatttgtatcttttctatgtttaggcacacaaatacttatcattgtgttataattgcctacagtattcagcacagtaacaggcggtaagattctgtgatctaggagcaataggctatatcatagctgaggggtgtaggaggctctactatctaggatgtgtcagtaaactctatgatgttcacacaacaaccaagttaccttacagtgcgtttctctgaaggtattcccgtcattaagtgatgcctggttgtgtttccatcttactggttcagcaaccccaatccaaaaatctgaaattcaaaatgctccaatgagcatttcctttgagtgtcatgttggctctcaaaatgttttggattttggagcatttaggatttgagattttcaaattaggcacactcaacctgcactcgtatgaagtttgtttctgtttttgctcatatgatagatttaatatctactgcatatatatccacggcccttttttcatttctgttagtgtttatattgtgctttctttttttccctccttggtgactttactcagaggtttattaatattatcagtctttccaaagaacaacaacaacacaaacttgctaacagtgattatgtctgggggatttctattatcttctttatgttcttaggtattttacaaaatgtacccaataaatgcatattaagtttatgaacccctccccctaataacacctgtaacaaagtaatatgcttttaaataaaattttaaaatgtagactggataggagattcataactggttgaatgacttttcctaaatggtatctaaataatttcatgaaaaagaacaggacagtctctagcgagaagcagagtctttctttctagccctattctgaacttttaaaaattgccaacttcaacaatgagatattggatacaattatgagtattaaaatatcatacatacattggtgggggaaatatttaaaatattggatctcagatttagcattccccaattttgttattgttttgaaaacattctttttggtaattcaaatgacacttttagatgagcgatttagaaacaagttgttctttcctcaagattctactgccattttctggaaaattatagtaataaacgaataactgtaagatgactactaacgtaagtggagctccctagagttaggtagtgcacaagctgcacatcagtaaccagtggcccttgcctagaatacactcatatctatataataatatttaatacagatacatgtaattgtaatactctacattgtgttaaaccacctgagtgtgcagtacagtgtggggaaacctatcagtatgatttcgtgtgaaaaaatggtcctagaaattttacctgagtgtgaggcagcctgacatgattaccagacaagctggtactttgatagaagttcatggccaaagagttccactgaatgctgtgaagtctggacccaaatgaaataataatattcacgctatgacaccataagctaagagggatgcttttcttgggatgagatacaatttgtcagatgagatgctcaaagtcctgttcttaaagaattgctgaaggcaatattcacaatagcaaagtcatggaatcaacctaaatgcccatgaacgacagactggataaagaaaatgcagtacatatacaccacggaatactacgcagccataaaaaagaatgaacttatatcctttgcagcaacatggatggaactagaggccattattctaagtgaactaacacaggaacagaaagccaaatactgcatattctcacttaagccaaacattaagtacatatggacacaaacaagggaacaacagactctggggcctacttgagggtggagggagggaggaaggtgaagatcaaaaagctgcctatcgggtgttacgcttattacctgagtgacaaaataatctgtacaccaaatccccttggcaggcaatttgcctatgtaataaacctgcacatgtaccccttacctaaaataaaagtaaaaaaaaagctgaaggaattagttctatcgatggtggaaaaatgaagacttaagtggcaaataatggtttgcattaaacatttgaaggaatgccatgtggaggagtaattaggtatatttcctgttgttttacaatcaacaaaagggaggtagattttaaaaaattaattaattaattaatttatttattttgagacggagtctcactctgtcatccaggctggagtgtaatggcatggtctcggctcactgcaacctccacctccccggtacaagcaattctcccacctcagcctgccaagtagctgggactacagacgcgtgccaccacaccaggctaatttttgtatttttagtagagacggggttcactatgttggccaggctggtctggaactcctgacctcgtgatccgcctgcctcggcctctcaaagtgctgggattacaggcgtgagccaccacgcctggccaaaaaatttattcttattttatggctccaagacaaattcaaagagaagtggatttggattcacaatacagaagaatcgtctacaaagcatgtcaagaatggaaagtgccattggggtgggaatccaggccacttttctagagatcactggtaatatgtgcaaggagtcaatctatgtgtaatatttagtgttttgcatgactgttggcctggctcatctacttccaggaatttttcctgaataaacaactagatgattattgaagagtttgtaacagtaagggatttgaataggttactaagtaaatacaaagaaaagaaaaagaaatgtgaaagaaacattaacgagagcaaagagagctgggaaagagaatgaactcaacggaacagaaactacaattataagcactggggtaaaaaagagtgtgagacattattagaaaatggccagtcaaaataaggttgaatgcaagacactgaggcaatggcccaatttttttgttaattagatgagagaattgtgattgctaaaattaaacttagattgaggaactctggtgaagtgaggtcaacagaaatagctaataggtgggaaattaccttagtcacttgaaacagaagaaacctattactaatgggtattaaattatttataatataaagaaatacaggccagacgcggtggctcatgcctgtaatcccagcactttgggaggccgaagcgggcagatcacgaggtcaggagatcgagaccatcctggctaacacagtgaaaccccgtctctactaaaaatacaaaaaattagccgggtgtggtggcaggcagctgtagtcccagctactcgggaggctgaggcaggataatggcgtgaacctgggaggcagatcttgcagtgagccgagattccgccaccgcactccagcctgggcgacagagcaagactccgtccccctccaaaaaaaaaaagaaacacagctgattatttagtgtcatgctacatccatagaggacttcagtatatagtatgaagaaagtgcttgctctatgtattaaattatttataatataaagaaatacagctgattatttagtataatgctacatccatagaggacttcagtatgtagtatgaagaagatgcttgctctgtaagtgtgcactctaggctagatattgacccagacatttgtgatgtctccatctgaaaataacaaaaagagccgaaaacctctgtagattattatttaaaattagaatatttaaattattttaagatgctaagaattacttgcattactttcttcaaattgaaggatgtgcataatatttgggaattctaaccaggaaaagagttttagcctttcattgaaaatgacatttatggtattattcaaaatggtaaaaagctgtttaaaaattcaaatgacaatgaatagaaatagaaatgaatattctagccatggtgtatttacatactataataacaatacatattttcattaaatgatagagtattattgaaaataataaacatttatcaaaatgacacaaaatgatttttaccctaccagtttaaggaaactcttggcatgtgcagtagttacttcccaattgccaagttcacgatcaagctttccattccttgtctgactggaccactccttggtagttgactttgttaaactttccctgtttcttgaaatcctcttcgtctccctttactcccacacttttctggcctatttttatgacctttcttagtgcttttcctatgattcctgctgtgtagcccaggaagttggcttgtgatgtctcatcttctgactttacacatgccccagtgtgacctcattcactctcaaactcctctcagcctcctatgtgataactccccagtgcctttctccagttctgatgtcttccagaactgcacaatcataaatccagctgccttcattcctccctcttcctcatccaccccactcaattcttgaccaacttgatactctcaagatacagtagaaaggtgtgtttacttctctccatctttattgcttcaatcctattccaaacacaatcatttcttatctggtttactataataacttcccaaatagtatctgaataaatgaacatttgcctacgggatatcttcaactgaataggcttcaggcatataagattcagcaggccgagaacaaaaccaacttctccatctaaatgtattctttctcctacattaattatctcagttggaagtattgacaggcacccaatttttcaaactataaatttttcatcatttttacttttctctttccagacacctcagtagttcaatcactaagtccaggtgattctatacttaaaacatgttttttcctatttaaaaaactttaaccatcagttcccctctcctcccaggttggtgagagctctttgagggcaagagtcatgtcctttcaactttgtattcccagcctttaacagagcccttaatctgaaatatacttagtgctcacaagtgtctgaattaaaaattatatcatatacaacaaaagggaaacatatatatatatacgtgtatatatacatatatatacacgtatatatatatgcacacacacacacacacatatatatatataaaacacctgattgcaaatgtgcaagatgtatgcatttacatgtatagatactggaaggggatttcaaatgacatgaataattggtgttttactataaagttaagagactgataaaaatttcaaataagaagcagcaaatatgttactcataggcaaaggggaatctagatctaataaactaaaaaattgtctggcatgagattcttctgctctaaaaagcttactaaatgagctttcacatgataaacattagagggcataccatctcacaagaaaggaacactccttttagatgacactaagagttaacactttaaatgtaagaagaaaagtggtggatgaagctattgaatgcttatgtttcaagaagagtgaacaatagaactttcatgcttcagagctttttccatacatgaggttataagtatattttaagtgagatgttagagcaggtgacaatttttaacagggactaaaaaattaattgcaactcaaaaattaacaatatttaagagtgaatgactgtatactgcagagtatgtaagtaagtacaccatctacaagtgctctgatttcaaatagtgatttgaatggacatgctgcctaactattttagaagagtattcttttaaaataatctaaaaaacacagaaatggatggtattttcatttcatcaccatatacgtgaaatatccagggaccagtgcatatatacaatgatctcatttagctgataggcaatagatatataatttcacacatctttcacaccaagtttaaaaaaatggtattaagtttaagaaatagcttatgttttagatagtagattctgtagtaggcagattacggactccccaaagacgcccatgtcttaatccatggaacctgtgaatgttaccttatatagcagaagggacttcacagatgtgagtaatttactggtcttgagatggggagattgtcgtgcattatcaagtgggcccaatataatcacaaataagtagaaggaaagtcagagcgagagttgtggccacagacacagatcagggtgatgcaattgctggctttggagatgaaggaagaggccaggagtcaaggaatgtaggtggcttctagaagcttgaaaaggcaagaaaagggtgtcttctctagaaacctccagaaggaacatagccctactgatgttttgattgtagctcattgagacccattgtggacttgtaacctgcagaactgtacgataataaatttgcgttgtgggccaggcacggtggctcacgcctgtaatcccagcactttgggaggccgaggtgggcagatcatgaggtcaggagatcgagaccatcctggctaacatggtgaaacccgtctctactaaaaatgcaaaaaattagccaggcgtggtggtgggcatctgtagtcccagctactcgggaggctgaggcaggagaatggcgtgaacctgggaggtggagcttgcagtgagccgagattgcgccactgcactccagcctgggcgacagagcgagactctgtctcaaaaaataaataaataaataaatttgcattgtattaaggcactaaattgggggcattttgttattgcagccataggaagttaatacagatgctgaagggtttcatgtgctcaaaaccctgataagtgaaactgtaatctctaacagtaacttttgcaatgtctcttaaatctgctctcttgcttcagttcacactgctaacactgtgttttttcaggcataataataataggatttattgaggcatcatataatgtcccatttccaagcattggtctgcaccttccacatgtattaacacaattaattcttttgacaaccctgtatgataggtatttttattatctccacattacagaggaggagaccatggcagatagacatgaaatatctcactcaatgttgtataactgctaaaacacaggatttgaacacagctttctggtagcaaagctatatttactcttcccagaatgaacttcatggcccttgaactgcatggctgtcaatgaaggtgaacgcctcactaatttaccatctatgttgactgttgaattattgtggcagacagaattttggctcccatgatctccacctcctggtgtcatgcccttgaatttgtgacgtttcatggaaaaagggactttgcagatggaattaagtgattttcaggtacttgtcaggcatgggggatatagggctgaactattgagagattaacaaataatgagaaaatgctaagagaaatctctcccgttatactcccatagaaatactttcaaggcttcagagatatgatatttcaaatgaggaaacgtccttatcctccatccttccttacttacaatccaggtttaaattctttctgtaaacttccctattctttgttcagatacctttatgcttctccctttgcccatgtatttagttatttaatgttccactggactataaactttttcagagtaggaactgttttagaagtctttgaattcccatttcctatcaacttcgacgcttatatagagaagatcttcattgtttgttacttgaatcgattattcaggaaaaactcctttacaaaaaatcctatgacagggattacattgttataggagctccaaattccaatagaggatctgttcacttcagctaatattcatccacaataataattctttaaaaactttatattcctcaaattattctacaggctttcctaataaactgtcatcataaggaagaaggaaagccatcaattttatgcttttaaggaaaaagcatataattttttaaatgtcataatttaaacttgttagtgaccccttatttcttctgggcacatgataaaggctaagaacttttcttctaagcaagatgaacatctcacccactcccctgacttttatataatttcaggagtttgctgattgtgtagagtccaatcttgcacatcctacagggcacacagcctcagatagagaacacctgaattaggtggatgagatgccctgcccttctgcgcttgactttctgcccagtgcccccaccctgccctctaccccatccaaaggtctttttgagataggattatttcagaagtcagtcaaatgtgcaatctcagcagttctgcttctgtgctgccccagcctgactagtgacaaccctgctgatgttccaatcctaaacattatcttcctctgacagtccacattagggaatcctgcctcaataagcttttccaatgggcctgccaccaatggcattgttctgatttgttgggctgaagtgatctctctctttccaggcctcaaagatggcgaaagagtgcctggtttcagagagcaatacgaaaaatgcagctttggaagtctggtgagtaaacaaatgaagccagacgttgacacttgtacatcaatcatgttcatttttcaatgtgcattggaaaggtttgagactcacttgtctcagcaaacagggttcaattaaaccagtaccctggataggccataatggacactccaagggcctttctggaaagccctttccctttggccaaaggcataagcaatgtggggtagacaggagtcttttgggtaacacgtaaactgaacctgtcagaggatgaggggccctgtctgaacggcaccagccaagggactggctgtagcagatatgatgatgcattgccaactgccatatccatctgcacccagatattgctcctagaggtgtcaaaacattgtaatttacaagtaaatgtgaggagaagaaaagttttgcagacatgtttcttaaatgaggaagagaatcacagatgaggattactgtccaaaagagagcttcagcaactaccgcccaaaactcagcgtgagaatggagatatcacgtaaggtgctgcctacttggctgatggtgagggaggtacaaaacgcagaggagccgacaggcacgtggaggggacagcgccaggtgggtgggaagatccagggagataatgcacatgacgtgcccagcacaatggccagcaggtcatgagtgactaataaaaggtggctaagaatcccaccaaaaccccaggcccatgttagtcctcatgtttctaaggggaagtgagttgtacttattgaaagctaggtatgttacataattgactcctcaaaacaactctacgaggtaagtatttttgcaaatgaagaaaaagaagttttaatggtggaatgatttatttaatgccacactgtgagggcatggaggacaggcattcaagcagggcggccctcgccctcactgggcctccctgccccgctttgggcacacagaaaactaccaggcaatttggacacctctaatcactgggacatcaccacagggtattacctttttatggcaaagccccaatctactagaagtcaagagagtaaaaaacaattagagcaatgctgtccaatacaactttctgtgatgacggaaatgttgattgagggattaataaacaacaggaaacatggttactgaccactagaaacgtagctacggtgactgagaaactggatttttatttttttcaaactttaattcattgaaatttacagatccacatgtggctagtggctaccacgtgggacagcagagaactagactacctgatttaaaaggaaccctagggctcatttgccctcatttcaccaaatagggaaatgtcctttgctttatgcctcatgtgttcatccagtttctcatagcacatttttaataacaagaaactcttccttttacttgggatctgatgcctttgttagaaaaatcatcccaatctaatagctacatcctcaggtgttataatctggagataaagttaagttttggtaataaacccgttcattattccctggggttatctcctaactagctagctctgctcttctcacacctggaagcatttaggtctctgagggtggccccagaggcatctaaattctctgggtgcacagtgttgctactgctatccacagcgtccatgccattccatcttgctgactggtactgatgctgagtgcatggatgcgatgtgaatctgagggtattttcctcacaacagtgcagtgctgcttgctaggtttcttccccagggcccgctcagccccaccacctctgcagccagctgcctggtggctgggctcgggagcctgcaacctcccaggcccctctaggaagcagctccctgctcttttcctatcctcataccattggttcccctgagaaatgctgcccagaggttaaattcctttggcctggcctccaggctagaccatatcttccatctttgggcaacttgggtaccttagaaaataaaatcctgtattatcttgtcaactaggaataaattctgttctccacttgcttatttctaccagctgagtggtcagctacccatctggtcttttccctcctgcttttatctggccactgcccccagagttcagtctgggtcaaacaagtgctaaagaaatcttggttgaataaaagactcagggagaatgacagtattataaaatcatttaacagaatttttcattatatgcttgtggacagaaaatgtgaggggaatacatgttacaacaggtagaatcaagatgggttgaagcgaagaaatgcaacgcttagttctattcatctattcatctaataacaccttcaaaaacatacaagagatcaaattggcatggtttaattttagggaattatttcacttctcagttccttagaagtccctgttaagtgaataattaatatttcattcttatgcatggtgatatgttataaaacattgaaccaaaaggaagtggaggcttttaaacatgccatattaggactaacccttattttaaattaacttcatctgggcttaaacaaagaggggagagaattaagcaagagtttgctatagaacactgaactatctgcagtgtgatacatgtacatgaggaaatacccaaaaccagctaagaagaaggattatgaagactacattgactttgacttctaagttcatcactgagaatggcacctttattctgatagacttccgaagtcttactattctgcattgttgtctgttataaggatttaatataaactctactgatattctctaacagcaccgtttatgcactggatacctgcagccacctctaaggtggcacatgtaactgttccaccttggatagtatatgactcactaattcaattttactttgatgggtaattacgcaacattctaagggtagatctttagagaaacatatcttttccttcaaacctggactagtaatttaacaaatagtaaaatgggtaaatctcccaaacacttagttaacactctgggatatatgaggctcatgtaccaagcagaattctggttcacagtaggctgagagataaccatctggtctcccaaaaagtaaggacagacaaaatataaaatcacactgacttatctctgtaagtctggattttgggtttgggtttaatttaattgggtttgaagactcctagtttacttcctaatcatttcagaagcagacattccaaaattaaattaagcaaagaatattaaatgggcagacagtgcatatttgtccgtaagaaccttacagtgttattaacaatgttataactacaattaggctggcagtctcatggggtcagtagtattgtttcttgttgaaacagacaagcaaataaacacaaggagccttgagtaaaggttctttcataggttgagatatacatttccactgacatgaaataatgtcctattacaacctttttatatatctcactttgcaaatcaacctcatatattacttgttttcaaacatgactactttccaaactagatttagttttacacctaatcatagaagtagaacctgttttttaaaccataattattcatttttaattgttattaaaagaaattctcatttaaaaatccttcaagagaagaccaaaggaaatatttgcaaagcagaggcatcatgttatggtggaaagcaaacagattgtggaatcagacaggccagagtttaaatctcagttttgtcacttactaggagaataatcttgagcaaatttaataccctccttttcatataaaacaggggtcagaacggctaccccagaaacttccagaaataaagacaatgtaagaagaacaatgtatggtaaacacaagtccatagaaccttcttagtaagttaaagttcttcttactctccttcttgttccctttaccccatcttcatcttattcttagtcatggtcacataaaagtggatccagcatgggatggagatgaaaagatgttcagtatggtgctgtggaaagagcactagcctgggagtcaaggggcctgtgtgttcctaaaaaagtcaattcctctttttttgggtcacagctggagaaaaggtatgaaggtaacataagaatttgtctatcagagcttaaagcccaaaagtgattttgtagtctgagtcaatcaggaactcctggagtcccaggatcaattgctgtctttttaatgaagggcagggcaccagggctgcagtctggactgctgctgctgctgctaatacaacttaccacactggggacggataactttccaagctcagaatacagatcccaattttttggggggaacttatcagagttttccgattgatctcatttattaagagtgggcttattaagaacagatacagaagtttccctcctggatcattaaactctttcttagacagcttagattgattaatagggaaggaatgggcagtagttttcaaattatagacagcccaggtacagggtggggtggggtggcttggggagagaatttagatttgaaacctcctgttcttgcgtccatgtgagtagtgctgttttaaattgttttacatgttttgctttatttgaacacagactttggtggttaaaaagtacaaaatgcactgggctaagtgatactttgagttgttccagacacctgcttctattgatggtgtgtgttcttggaaaattaataaagaaaggcataatgagatgctctttctagaaactttagcaatagacagggcgtaggccacagcaaattagatccagccaccagagtggaaagggcaggggctgggactggaaggaaatgtcttgaatatccatcaagtgtggaattagtgttattttttattttatttatatatattttttgagacaaagtcttgctgtgtcacccaggatggagtgcagtggtgctaccttggatcactgtaacctctgcttcgcgggttcaagcaattctcctgcctcagcttcccaaggacctgggaactacaggcacatgccaccacacccggctaatttttttgtatctttagtagagacggggtttcactatgttggccatgctggtcttgaactcctgacctcgtgatccgcccgccttggcctcccaaagtgctgggattacaggtgtgaaccactgcgcccagccagaatcagtgttattaacactgtgagtcacagtgtgggtaacatcaagataacttgaaaataagaggagctcaggaagacttttgagtgccactgcttttccccgcctctctccacaactgagggccatggaaatgccacttagcctctccagatctcagttgtctcattgtaaactgacaatcttggactaggattcccttccaaattatgtaataaaatagctgcacaaaaggaaagggaaaagaagtgagagaagggagtactggggaggggaaagtattgctgagctcagctctcttgctaaagagggttcacggggtggggaaggaaggaggaggggatgaaattaaccactggtatgggtttctaaggcttgtgtcagtaagatcagtgaacgaagaaattaaggtcctgcctagcatgggcacagtgttccaggagtgtcatgccccactctgggggctctgtgatgtggaccatgggtggggcctcgtaggcaaaagagaagggctgttgggaggagaaatggggatggggaaaatcatttcaaatttcccatgatggaaaggctacaggaattggttatctagatttacaaatagaatctaataaataaaacttgtttttttttattttttgtttttatagcagtgtgaaagtcaaagtacatgtttttaaagaagcatgaaagttcagatgagacacacttgatggcttgttcagttcatgagatcttctggcatgaaataaaatgtttctttttccatgcagtgattgcgtaactcaaatatggcaaagctacctacacgataattttcggcctgtggatttgatttttcataagcctcaccacacacccctcacagaaagctcttgtttctagtggattcgtttcacctcctttgtgaaagccttagagagaaggcagtaagcagggaaaatcagctatttataggcgtttttgactaaaagtgtctgctcagcgtgccatggaatacttccaagaggtgggagaacaggaaacgatctaaaatcgactagaaggctggaggagtgttatgggggaatgattttgcaggggagtcattttcagaaagctcaggtttcatttgcaaacaaatgaactgacaccccttgagttacagataagcctttgaaacttttgctagttaaggagagaagacaaagacataaaatttctaaggattacaggtagggttcctttaaaggactttaaaaggaaaagtcctgtagaaaggcctctctccctacttatttactgcctaaggggatgctagccagatggacgtccacagaggagcttagactggcaggtggcattcagagtgtaaactgcaggtcctgggatggcctacagagtcttatagtgtccataggatgatctctatcatcactaatttccacttttataaccaaaaatggcaagcctatttggtcaagttttcataattaagagatataatttcattaaatgtattaaacccttcctgtgaattctgaatggttttgttttcattgttttgatgacattggagaagcaggcgaggtagaatttagactgcccaaagtcacagggctcacagaagaagtttgaacttccgatggttctgtggagaagaggtcatgagagagatctggcttcagtgtttacttgctcttttcaatttctacaacattagaagaatgatatacctggcttagcgactttgggcacgagcaaagaagagtgatggccaaggacatttggtcatcttctatcaatggtggaaaagcaccacggaggaaacactccacagagaacctggttctcctaagccaattaaagaggtgatgatggtggatagagttcccttgtagacacctcctatgactgttattactaattaagcttgtcctgttgacttaccagagctgtctggaataaggcagcaggagcttgacagacttaacgtatgaaaacaaaagcaagtgtgtattgcgttttttttttttttccctgtatgaatacactaaagcttgaagaagccagaattatattccatcagccaatatcaagccatgggaaaacctgatccactgaggctgagctatcaaaagattaatccaggctggtgcagtggctcacaactgtaatctcagcacttcgggaggccgaggtgggaagatcccttgaggccaaaagtttaacaccatcctaggcaacatagcgaaaccccgtctctacataaaaaattagtctggcacggtgacctgagtctgtagtcccagctacgctgaagggtgaggtgggagggtcgcttgagcccaggaggtcaaggctacagtaagccatgatcacaccactggactccagcctgggtgacaaagggaaacactgtctttcaaaaaagaaaagaaaaaaagattgactgtgatactctcgacttcagacgaaagctttctgcgtttagtcggcacacaagacagtgaaattttacacccacactgtgattaagacctactgtcatcccatattggaaagggcttttctttaccacagaatcagacatgctaatcccaatgccagcttaataaaaactagatgaagtgaaatacaaaggaaaaagtggtatggtacatgaaacatgggaaagagctaaagcttgttaatgtttgaggatctacaaacttggaatattttcacactgtatttttcatttatttctcaaatttgaagttaaatttgtttctaagacctgaagcaaacacagtcatatcatcatgcccattttacagatgtagaaatagaagtgctaagtagagcccaaagtcatgtagcaagccagcatcaataaagcttgcagtcagagcgcctgaatcccatattttcatctattaggctctactgcccccttcagtaaatacaatgagaaattaagccttacagttccctagaactgggttacttaaaatgcagttctgggattgatcactgtcagaatcatcccatatctatgaaatcggaatctcttgggtggatgccagagatcctcattttatagacactctcaaggtgattcttgtgcacataaaattaaggaagctttacctctaaatattcaatgatagagcaagtggccatacatatatatgattctctacaggcatacatgtgatattattgtgcccatatgtacccgtattgattccactttacaatatttcatgtagcatttccaattttagagataaatcctttccaatcacttacttttacatgtagggggcaataactaagagattagcttgtagcttttagcgtatgtatcctgcacactattcctctcagatttgctgcagttgctcccatttaatatatttggtcccatggtcccattgttccaatacgtaattcctacctgtcacaccatacatattttatacataaatacatctatctatctatctatctatctatctatctatctatctatctatcaaataaagtttggcctttgcaaatatggtaacagctatgttaatttttatcctggagaagtaagatgagggatgctgatttcaaaggagtggaagatgctggaaggatgcatgctgtcttcaaaatctaaccagggctctgagcaaattccctaaagatcacatatcctaatgtgttctgctctatgcatcctcctttgctacgtggtttaccatgatccagggaaaactcatccattaaaggaggaacacaccaatttcttttctttggaagttaaaataaataattgcaggcattatttagttaatctttgcctcttctgagactgttgagtcacaaacttgcttcaactctaactttcagataatgtcgcttctccctttgcttccctgtgccttggccccattgccttaaaaggatgttatgagaatggataatagaatatgtacaacataatgggaagagaacagcactggtagccaggcagtgagcctgcgagtgccaggttccactggcaagatgactgatttcatcgaggtatttccttaggatttttctcttttcaaaaaactaaattggactaaataatttcaaagccttcttttacaaggagattattagatgaaaaatagataggaagatacaatgtccgcattgcagggagattagtgtgaatgggaagctacaccagatgaccttctgatcaggaggttctactattctaaaattgtcattttaaggggaaaaaaacccaactctgcctggtcctttaattatgtatcttatgattttagagtctcggagaattaaatcagggaggagttagacaatcttgcaagcgtatattaaattgtggttaaaaaaattaaggagagcaaaagtcatttattttacaattgttggattctcccttattaaggggactaaaacctctttattcttacaccagagaagcaggacatccctaactagtctacacgaatggtccaaggtgaagttcaatataatcactggaaaagcacagtaatgaattttccaacgtctatgaaaaatctgtttctccacttcatagtcatacctcttccatggactttgtgaaatggcactcttaaaatggatctgagttcatgaatcagagatcaaaaacagcatgtgtataaatgcatattttagaagtattgttgcagggatacctatgcagatagaaggtgtatatataaacctgcacacatgcacctggcatgcagtaaccgcaggctcacataattctgcttcatagacagttctgtgatatcacaagcctgatttttgtgggaagtttcctaattctgtgaaacaattagtagaaactccagttgacagagaacagtgacctaatatacacaaaaggacccacatatccagaaaattcattgtataaatatatcttagaaatggaaaaaaagcaggcatattgctagactttagcaaatgaaacaaaaagtttttaatgagagtcctaaatattcctacatttaaaagatcagggaatcagaagaggtctttctttaatcacgtgagtgctctccaagacaaaaaaaaaaaaaaaaaaaaattaaaaacaagaatttggtcaaaagtaacagtaagagtaaatgttatgcctttctttacacaatattttctcctttatctctgtgtaacagtaattaattgattctttatatcattaccttttagtttataaacatagaggactgggttgaatataagtaaatcagtcactgaaaaaaaattaatgcaattacctattgtggttttaatttaagaatttggaaaaacacttaaatatgaatttaccaaaataatgtgaaaaaaaaattctccctgtgtgataacccactaagacagattgttgtctttgaacctaaacccaaagtggtggaaaacataatctaattacaaattaaagtcagcctggcaatactgcatatattttttagcagttcctaaaaaacctgacacaaaagagcaatgtgttctaccattcacaaatcactgtgtaaaattgtgtaatgccatgatctcatgtgggctagagactgtgggtgaatagttctcttaaagaatggtgaatgattaccttgatttactgtctttaatttgcaatcaagcaaactgtcttctgaggagaatggaaaaaggggaaacgaaatctactggccactgagagatccaaggctagtttttctctttcactctttgctaactaatgctatgcctttaattagtagattggaattctgtgagatcagaaagtgtgtgttacaggcagaaacctctgactgtggctaaccaagcactttggtgttgccgaaaatgtctttagaaaacagtgaaactgaaggccaagaataataaagtttctttaataacttccaagaaggctttcctatatatttttgatcttccctttactaccactgagtctttctggactgctgctttctcacaatgttttgtcaatttttttttccctttattaattggacctgacaatagtgagaataaaagagaatcagagagagagaattaacagaattctgctgctgatcactgattccacatccaaagttagcaccaggcaggagcaatctcatctttttatgaatgaagaggggcatctctaccaagatcagtgaaaaacagggagaagattgtgcaaacccaataggaaatccattcaggaaccttgacattcacttgctggattattagggcaatttaaattaaaaataaagaaaatcatcaatgaatgtggtggatgggatttcagaaaaaggcagcaaagaaacatcccagtagccaaagtcattagcagaactgttcagcactttcataaattgcatgtaaagtagttttaactgaattgggagacttaaaattgttctaacacaagagggaggaaaactcagccagggaaagaaaactcccactgggcaaagatggaaataatcttgaaccaattattgaaaaaaataattttacctgtatttaaaagatcctggattcatgcttatgaatgcttcctcagtgatcttgtgtggtaccttatttaagcagacccccacccccaaaaagagcaatcatcataaatgttaattttgcaaagcaacagtaactattcagaatcctggtcctggaaaacaaccgatcatatttcaatcaccagccatataatatcctctaagagcacctagcagatctaaggagatcatgtgtcaattaaagattttataaagcccttgtggagacacagatttgtagatatctgatgtctccatctgcttttttactatctgtgcacacattaatttgtcagctcttccagtctttctagccattatttagaggagaaataaaatcacaaatactaccccttcctttccctaccacaaaaaccatccaaatcaacaccacactattaccaaatacaaagtaataaaagagttatacccaaacctggtcagtccttccatttcttgaaacttgcacacaaactgaagaaacccactcagccttaaaaaggtcgatcattttgctttcctaaaatttcatctctgggagtgctttccttctcggtctgtcttgctctctctctcgctccctctgtctctctctctccacttctaccgcggagagagcgttttgtttcccttttcctgtttctacggctgaatgaatgcaaaatacactgtttgaagggatttttcttttaggttaacagttggaaatctaaaatcttgctcttctgaatggctttatatgtcagtcactcaacatacaacatttacataaagaggcataaacagaaccaagaattctgctttttaaaagcaaaaacaaaacaacaacaaaaaccaccttttattctatctctgaacctcttcctattttatttatttaactattaagcacttaccctgagatgtgccataaatgctttattccaaatgtataagagccaaccacatctcaactgagaattaaacagttttaatgtcttcaaatccatgttcctgctcccaaccctaatacagacagtcactggcagcggtacaatagttctaaacagcagacatctgattcttgacatttaaaaataacaatattggaaaaaaaaggagtccctttttttattaactgcagacagcttgtgagtgagcacttatcactcataatacaattgaccgtattaactgggacttgcaacgatttcaagctacagtatttgattcctaagtcaatgtcaggcagaggctaaatacttatagacttctcattttctatagaatcatggcaatggcctaaattaagcgaattctaagtgataattccgcaaagagagaagcagagctttgctagtatttagactttattattggtgattactaatttcatctttgttagtcttgaatcaaattagggacataatcagttgtttcattgttagtctaatttcatatccatgccctcttaacttctcacatgcatatgaggtcaaatgcacacatacatttaccacaaaataaatcaagtaataaaataaaaaatacgcactcatttccattactgaagcatattacggagttgggtagatttgggatcaagtgctagctcccccacttactgtttatgtgttcctgggcaaatgatttaagcatttgtgcctgttttgttgtctataaaactaaagtaaataatactctacaaagttgttttgagtacttaatgagacatacacagtttctggcacataatagatatttgatatacactgcttccttcctctgctttgtatttggaggaggtagagattgggcatagtaaatgaatacagactttgaaagcagacaaatcagttttgacccaacgtgttgccacatactagctgtgtgtccttgggcaggttacttaacctaatttacgaaatcttagcttcttcaactgtgaaatatctctagaattttaaagagcaaattagacaacatctgaaaaacatacagtaggcatctctgaaatgagagtcctgggacttccaattcttgaaaatagttctaattagtactctgacacatgtaatttacgagtttgaaaatgcatactgagatcatacatcttttggaccaagcgcctcattttctagcagaggaaggaggtccagagagctgaaagcatgtttccaggtcatgttactagttagcagcaaataaggactagaacgctccgggaactagaagaatagtgctttgcctactaagtctctaatattgaagttaaatccatttgtaaatccagcttcaatattagttggcaattaaggcaatagagctgaaaaaaaaaaaaaaagaactccaaagaaaccctctttccctctctgttttcccaaatttacttctaagaatgagcctatagatgaaattattcccttggagctagctggcacgggctaaccctatcttcctcagcagagcttgcacggggtggcagatcctcttttcatttcctagaagcaagaagggagccagaagcccagttctcaggaggtattttctattctcctctgaccccatatgaatatatggctctttcttccctttctttacagcatctcttcagcctcagcacaggggttgggaggtctacactgttttacatttaattctcttactaacatactacctcccaacattgaaatatagattttttcccctagtttgaaagtcttgcataaatagaagcttaatacattcaatatctattaataaggattaacttggagtttagtttaaaaggttgaactagcttggttaattatttcccaatgtaggacagaatatgttaaactgttttcaacctttcaataatttcagaattgaaaacaaaggtgctttggtgtcaaagacagatgagctattactctggggaagaagggaagtaaagggattaatatgagtgtgtctgtgatccattgtaatgaatgttttagttctgtatgacgggtgatgtatacatgggtgttttattttttttctttatacctttctgtaagcctcaaacgtttcattacaaaaatgacttaaagaaggcaaatagtttgaaaatagaatttccaaatctttatagtaggagatccaataatgctactactaaatcccatacttaagcctttaagatttcattctcattttactgaaaaactttaataataatatgcttattttaaagatttttattttcttcttgctcaccatttttgatgcccttgatttcaggtctgtgctagggcatattagaaagagcttggttttggcatcaaacatacttgagcctaaatctcagttgtacaacctccagattgtggggctttaaatgacttgatatttctaagtgtcagtttcttctcttataaaaatagaatattattacattcagtaatcttgggattatcacaaagattaaatgaaataagaaatgggaacacatttgctatagcatctggtatatagtagattttcaattaatatcactttccttatctttccacttttcaccactacctgagatcgcaactccaaaaaggtataaaaaagaaagaaaaatgaacctaaggaaggaagaatgtaggcatataggcagatataacgaaaacatttcattactaacaaaggcttatgctagatccatacacagcatcctttactctgatacttctcatctaatctcatcattacttacttaagtacaggtgtttttgtttttgtttttgtttcctttcagtttgttttgtttttgccactggtcatagaaccttcgcagacaaaatgtgtggtactctagggcttttatctctttactccttactttttgtaagacagatatccttatcgaaatactttactttcagtggtgggtgaagctttatgttcttaaagagtttctagagctttcggttgcaactttcattaatggccatttctctaagttaagagactgggttctagtcccacctctgccacatgctaacggtttaacccactaagtatttacctttctttgtgtctactttttcatatgctaagtggattaaatgattctttgagctctgaaattgttatagttcttgataacttattaacatgtagcaaccttacaggaaattaggcaacaccagcttcagtgggaagtactgaccacataattgtgtgtcgtgtatgaaaactgtccatgtgctggtggcttcttctgaactccaagaacaggctctggcactgcccttgtccagggattgccagcttggggtcttctcagggattgatggaggcattcccaagggagccagacttgtcaggaggagttcaaagggagcaaaaaagatgaactcctcaaaggaagaatttttctttgcatttcttcttaaggtgggagtgtaaaatgggagtgggtatgttatacttttatagctcagtaatttttttttttttttaagatgaggctaccaggagagaacagagaagaaaagacactctgaaaaaggaaaagatgagagttcttatggaaaaatgtgccttgggaaaaattacaatactacagcaaggaggtagggaagaaaaacatctctctcctatatttttatccaggtaacatctggtttcagtgaactggaggaaaacacaaggagacagtggcaggggaagagcagcctaccgtggctctgtaagtgtgtgggatttacatgctgacactaattgtattttacttctctaatccttcctccttttcctcctcctctctgttgtcctgggtgtctgcagctgtgcttgtcaggtccccaaactggctagctccccacctcctcagggcacagggcgtcttcctgatttgctgtgccctcgatgtggaagctcaggtcggggtgtagttactgatggttatgatgatgaccatcgcagtattctaacatagcttcaggcaggatttcacaatgaaaaccaccccacaaaaccctgaatagatctaatgaaactctttccaaaattcaaacgatcgtcacgtatttttgaattaaagaaaggtggacttcttttaaaattctctgtagacttccctttcctctctttcccatcctatgatccctcagacaaaagaggaagcccataataactggttgcctttccataggcgtgcttttcaaagcacttggatatctagtgtcttaagataacccggtgaggtcggtagcatttgtttcttttcattttccctacaggagcaattcggcacagagatgccgaataatttgcacaggttcctatcttaatagacaattcagagtagtgccaagactagaaccaggagaaatgcccacacaagcatgccaggtactacttctaagcctccatcattgacagaaatggtacctgcaggtactggcaggagcgttcttgctgacacgactcggacttcaccatggcctggtccatgttcaccgaggccttctggtaaacctcccgggcccggctcacggtgagcgtggaggaccaggcgctcttcttcagcagcggggtgtccaggctgaccggcaggttggcgcaggtggagcacttgacgtcgttgttgctccgggaggccttcaccgcctgctcgctgatggtgttgtaggcctccaggaagtactgtgaggccgagcggtcggggcacctgcccatggtcatcacgcccgagggggcgtggtagatgcacatgtcaccatccaggttgtcgtccgagctccaccagcccggggaggtgctgggccgggccttgggctccgcgcgccgctccttgctcttgctgcgtttgccatagcgcgccgcctgcgcctcgtcagggctggccttgcccccgttgacgctgcccttggacggcccctccagggagtgcgacttggtgaagagcttctggaccgagtgcaccaggtggcggatgcggccggggctgtcgctgcggtgctccacggccgtgcgcttgtactgcagggtgtgatagccatcgcggctgagtggcagctgccgctcgaactggtccagcaggttggcggggatgcggttcgccttggtggccagggtgcggggcaccagggcacactcgtccttcagctcttgctgcgaggtgtagtgcctgcgggggaaggtgctgctggccagcgggtcgctgaaggggcccacgcactcagcctggaaggagttccgctgggtgtagtatgggtggtctgcggggtggtgctccactgggctcagcaggtagggcttgcggtcggagtggtgcgacagcgagtcacaggccgagtcgcaggtgaccccgtggtgatggctgcggctgcctgatagccctttcatggcggaccggaagcagccgccagggtcatggacacccggaagtcaggctccagacccgtcttgggcagggatctgggggaatgaagaaaagggcaaagtcgttaacatttctcttggaaattaggtattgcactttacagggtcttgctctgttgcccaggctagagtgcacaggcgccatctctgcttcctgcagcctccacatcctgggctcaagccatccttccacaccagcctcccgagtagctaggactacaggcaggccccaccacgcttggctaattttttgtagagaggaggtctcactatattgcccaggcttggtctcgaactcctgggctcaagctgtcctcccactttggcctcccttaagtgctgggattacaggcgtgagcaaccctgcaggcctggtattgatctcttgagggtgccatctgcgaccgtgtttttttggcagaacttaatcagtgtcccctaaaacagcttgaacgcattattggaagagctctgtcacctctgtggggcaggaaagctgactccaaagcctgtagggagagaaggtggaggtaaagctagaaaactagaaaaaggaggccgggcgcggtggctcacgcctgtaatcccagcactttggggggccaaggagggcggatcacctgaggtcaggagtttgagaccagcctggccaacatggtgaaaccctgtctctactaaaaatacaaaaattagctgggcgtggtggtgggtgcctgtaatcccagctattcgggaggctgaggcaggagaattgcttgaacctgggaggcggagcttgcagtgagcagagatggcaccactgcactccagcctgggggacagagccagactccatctcagaaaaaaaaaaaaaaaaaaaaaaagaaaaagaaaactaggaaaagaaaactatatttaaaaaaaaaccaaattgtttttaaattatttgaaacaataactctccttccctctatgaccccaataactggatgtatcgttctcttgcttcttgggtcttattcttttttttctttttcttttctttttcttttttttgtgagatggagtttttgctctgttgcccaggctgcagtgcaatggcacgatctcggctcactgcaacctctctctcccgggttcaagtgattcccctgccccagccttcagagtagctgggattacaggtgcctgccaccatggctggctaatttttgtatttatgaggtttcaccatgttggtcaggctagtctctacatgttaattgttaaagatagaactggagaggggctcagttcctctaggaaacctctgctggctctcctagcagagagaattagttcctctcttgtgtttccaccacatctgaaactcactccccagaacctacagagttgcttgcttcaggatctctcttccggcttatgttccttgcctcccagtctattagtctcattatgtaccccgacctagtgtcgatccagccatgtaagcacacagtaatagcactccataagtgtgaatgaaaatgtgagttaaaaaacaagatgagccgggcgcggtggctcactcctgtaatcccagcactttgggaggccgaggcaggtggatcacgaggtcaggagatcgagaccatcctggctaacacggtgaaaccccgtctcttctaaaaatacaaaaaattagccaggcatggtggcaggcgcctgtagtcccagctactcgggaggctgaggcaggagaatggcataaacccgggaggcggagcttgcagtgagccgagatcgtgccactgcactccagcctgggcaacagagcaagactccgtctgtctcagaacaaacaaacaaacactaagatgaataatagaagccaatggcacctcgtatctttaggatatctctgtcttctgttgcatgttttcctttttgaattctgtaggaacaacttcaccacacaaacaatccccccaggttactcagagtgggaaaaagtaaagatatggcaaataaatcataaatgtagagaaaatctgcccaggtatttctgtcaattgagggtcaagagctttctctaaacaaacagagaacaagttaagcttgactaggctaatttgaggatcatatatctcttcttcctagtttaaggtttctggttgagtatttacgcacaagaccaggcgtggtggctgacgcctgtaatcccagcactttgggaggccaaggttggagaatcgcttgaacccaggagtttgagacaagctgggaaacatagtgggacccagtctttaaaaaaaaaaaaattagctgggagtggtggtgcatgcctgtagtcccagctactcaagtggggagaggattgcttgagcccaggaggttgaggttgcaatgagttgtgaatgcaccgctatacttcagcctgggtgacagaatgagaccctgtctcaaaaaaaaaaaaaaaaagttaatagccgatggcaaaatgaccaaaggatggcccttgaaaagttcttgaggacatgagtgaaggaccccagacctaatagctcagcctcagggaaaagtcactcattcatatcccatgtagggtatctcagtccatttccaagctcggatcttccggagttttagtaactaacagaggctgctattccatcagggcagagtattttctctggactccaaaacagtgttagagtcagtgcctgaccaagttccttctgacagcctgattttctttcaagacttcctacaatacaaaaattgccatataaagagtcatcttggaaagccaacatgactctctaaaatatcactaatgtcatttcagatattcctagagagatagatatgtggtttaattaagaaacaaaacatatagtgctgggtgcggtggctcacgcctgtaatcctagcactttggggggccgaggcaggcgaatcacctgaagtcaggagttcaagaccagtctagccaacatggtgaaacctcgtctctactaaaaatacaaaaattagctgggcatggtggcgggagcctgtaatatcagctacttgggaggctgaggcaggagaattgcttgaatccaggaggcggaggttgcggcaagccgagatcgtgccactgcactccaacctgggtgacagagcaagattccatctcaaaacaaacaaacaaacaaacaaaaacaaacaaacatataaaacacccacactggacctcatgaaaaaagatttttgagaggccaggtcttgtctattccatgagacatactgcatctgggagcgctcatgacaatgttggcaatctctatccatgctttgtgaagctcctttcttcctcctgtctcccagtttctggattgaccattcaggaataatgatgaaaggttttaatcagtacagtcactcaaaatttgttagtctactaaattgtgacgtccttaagggtagggactatgtttcacccacctagtatttggcaaagtgctatcctagtggatagtgggaattaagttagtagaatatttactcaattacttaatgcattaatgcaaaatttcccaaagtggttcatagtgtgattcaagtagcatctgtttaatgaaaacatgactgtgtggcaaaggccaggctgggcaaggccaaggaaagatgcccaatagttggggggaccattccatcagggtgaccattccaaagaccagtcttcagagcaaggcaggaagcagactggtgaacactccttctgacctatatacctttgacttctaactctgcaactcactgggcaatatcgtaccttctgccgttctacctgtctggaagtaaagtctggggagtttgcctaacctgctgactacaggatgcttagacagagggcaatccgcctggaagagagagagaaactgactcttgaagggacaaaaaaggaattcaggacttatgatacctgtggataaggaagaaccgataggtaaaaaacgtgtccactggtgacagactaatgaaacagaaaaccttgggattgctttgtatgaagttatggtcctaaaagtaggctgtggcaaggaagaatgtaagagggttaagtatgtgtttttagcaaaactgtggcacaaactaacttagatgcaaaaatccattgcataagaaagtctctctctacaaatcaggttccactgaggacatttttgcctttcaaatacagacttataaaaagcaaaaacaagattctattaggattatagacacatactaacttttatgatcacatatagtagaatctcaatatataaaatgatgtggaataatgtttcgaactttccttctcaagcagtttgaatcttgggtagatattttctgctaaataaaatgtgaaactggcaagagctgaaaacatgaattatacatgtttactccaaaatatacaagattattttaatcaggtattcagtatttaattatctttaatatgtgagcaacattccatgcaagatgacgttacctgaggacaagcagagcaaacgaagagctgtttaaggccactaatgatgatttaagttaaatgatgtaaccaatgataatttctgtaaattaatcatacacagtgtgttttttactaaaatttaactgggctattttcagcacaggacaagcacctctattttcttggagggtaacaaattgcatccagaataaataagctaacattcctccttccttacttgtatttgtaaaagagatattgagatcttgatcttttttctctatgatgtgggaaaagaaggtcataaaaaatggcaataaacatttctaaatgctaaatctatctttctggtcaaggccaaataaacaacttaataccatggccctttctgtaacaaatcttacactctcttctatcgtcttgtcattttaaaatgaaaataggtcaatttgtgattataaaagaaaacacattctgtgacttcttggtgagcaagggcaaatgatctaaaatcctaaggccattggcaatgggtagacaattgctggtggcacctactatggaggtcctgctcttccttctctcattcttcattttcctcttgccttactcttaaactccctttccagcacatttatctctgtcacttcttttttcccccctctcctaattaatgtttataagttgtatccatgggtaccacttgctgccacctgtggtgtgaccaagagcatcattagaaagcttccttgcctgctgctgcaaagacgaccaaatgcctacagtgaatccctagtggtcagagggcttatgatatattgtgagagccatgtcataagccttttggccactagggattcaatgtatgcacttcatgacctagccacaaaaaaacatgaaaagagataaataacaattctcattcttctatgcattcttgaaaaaagaggatgctagcctctcaattagattttaagtaatgataacaattgctggaaatagagagggaaattgcctttcaggccttgttctttgagcaaggatggggactgtggtcagcatgtcttcatgagggtttctgtgactaccagtgattagctctaatttcttcttgttcgctgtgacttcaacattctgttttattgtccttctaagttcaattttaccattgtaccatgtctcctgatttttttgcttggataatttgttgactctgtttgcagccatgagacaagctcagagtgtgagatgcacagtttttccagagttccaacacctggagcagaattatcactgtccagatgatgaccaaaacaagaataatccagcactgtaaaggaaattttcaaggtaggtaatttattagacccaaggaaaacacaaacacaccacatattagaagatgctgacaaaggggaaatagtcttgcaaagctggcaagtccttattccattttgatttttgtgcatgtctttatttagagctgcttttcttgatttttctttacatgcagaaataagagcatactgaaggccctcctctgtcttaccccatgaggatggacaggcaggcaattgcgacttactttagaaagaaagtggtggaccctgcccaggagaacaggggcactgtgttcttgtttgaggagacatcaggaagaggaaatctccatgaatcttttcagggtcaagctgtcctaaaaatttcttttttgaatttttgtgggtacctagtcatgtatatatttctggggtacatgagatattttgatacaggcatataatgtttaataatcacatcaaggtaaatggaatatccatcacgtcaaatatttatcctttttgttacaaacaatgcaattatactcttatagttatttttaaaagtgcgattagattattattgactatagtcaccctattgtgctatcaaatactagatcttatcattcattcggacttgcatctattttttttgtacccattaatcatcctcactctcccaccttagcaacacctctcaactacccttcccagcctctaaatgatcatccttctaactctctatctctcaagtcaactttttggcatccctccacctgccagaagcttgtccatgccaggttataacataccactaaagagaaagaaaagattttcttgttgaaaagtacaagcagccctgaacaatgactacattttccattctccctagatgtgcctgggtgactatgctggccaatggaacataacttgaaacggcatgtgtgatttctggaaaacatctctaaagtgaggggcatacgcttctttaccccttctctggctggaacgcagctgtgggggctgggtgaatagtgatctttcccatgaggtggaagttacagtttgaggattagagaaacaaaagataaaggttctgacctacagcggagtgccatatccgccctggatgtgcacctctgcattttgtttagtcgagagaaaaatagacctttatcttgtttccttatcttatcaagtaaaggaagggcctgcgctggccccataggaagccagagtcccttgctattgaaccacgtgacaactttagccaagggctctgcagagggagtctgtgtggagagaggagacaaaatagctcgcggttattttgctttctgtaattttgtgtactgaaccttgcacctgcacctgttcctaagtgagacaggtagtcagggcaaaatcatgagacccttggtgaagctatgtcaggatgcagcactgtatttgcaggtggtggtaatccattagaggaatttaaacaagacagtggcatggtcacacttgtgctaaagatttctctagctgtagttagagaatacatgtgggagtggggaggggcaaaaagatctcaaagaagcaatgatttcttgcaagagcagtttatgagagaagactggaagaaaagaaggagtataccaagagaggaggacaatgtcctggccagctacggcagtgtctcctgattcagacctccttgctcacacatgcatgctccaaccacagtctgaacacatacatgacatttttttttagacagaacaaaattaattttcccgtttacttataataaatcccaattctacagagattgagaatgatgaatgcccaacaggctgatgattttaaattattactttttaaaataagaaaatggttcttactactaaaaaatgaaaccatggcacttttgcgtaaaagtaaacagaaaacggccgggggcagtggctcatgcctgtgatcccagcactttgggaggccgaggtgggcggatcatgaggtcaggtgatcgagaccatcctggctaacatggtcaaaccccgtctctactaaaaatacaaaaaattagccaggcgtggtggcgggcgcctgtagtcccagctacttgggaggctgaggcaggagaatggcgtgaacccgggaggcggagcttgcagtgagccgagatcgcgccactgcactgcagcctggacaacagagtgagactccatctcaaaaaaaaaaaaaaaaaaaaaaaaaaagaagtaaacagaaaacttaacagaggtgagaatgtgagttaacattgtccaaatgcccactgtttggatattttctgaccttttgaaattgtacctgaagatgataactcaatgtcatgttctttcacttttccaggcttccttacttgaagattttcatgcgttgtgtgcttaaaattatacaagtactattagaacacctttgaataagcacattctgaaatataccaattatattactcaaagtacaatgctgagccattttatagatgcagaatgtattttggcttttcattaacattaattgctgtcctaatcatctgcagtttgatttcgtctgtgaatacctctgtcaatcagtctgctcctacaaataaatgccttcggaggcatttccttttcaaaagatatggtattgttaaaaaaaaaaaaaccaacgactcaactgaaatcttctccaatttggtcacagtaggcagcacaattacaatcacctgcatctccatacaaagcttttaaaaagtggtttcataacagtttttgagaataaaaaggtggaaggtagtgttctttgaaaaatgattaataggtcattattgatattggtggttgagcaaaatgtcataggatttaggagtgatttttatgtgaagataatccaggcagtaaacgataaaatctcctaatcttattttggactgacagagttcaaatatgcctgtgctgactctatgggacctcggagatatgcttcctatggaattgttcttatctggattttcaggagagggttggttatctcggctaaatggacagatgaattcccttgggagccagctaggagaatgtggttaccttaaccagccatggacagtgcccttcaggaggtgctgcagcagggggacagcctgtcttatgcgggtacaattgatgggggtagaatattcacagagaagagaaaaacccatcagcgtttactccaaaaaaagttgggaaaaacttgcaaactactgatgaatctaggagaaagaagaaatgatgacagaataaacctgtttaatggtacctaaagacagccgtgatggaagatggaaaaacacaaaaacaatgacaatcaaaacaatatgacaatacaacttgaaaaggagcagtggaaatagcctctgatgaaaccaagttatttttgtctagattgctcatgactagctgagtagtcttgtgaacatgttctggcatattctatacaacttgtttcacagccagattttatatatacatacatgcatatatatatatatatttacctgaatcaaattttctcttataaagtctctttctttaaaagctgttgctcttcttaccaagtttgctgtacaaatctactttccttagtgctgagaccccaaaagtgcagacattaagcccttttgtggtagctgttcagctgacacctgcttttgggaatttcttccctactcacagcatctcctggtgaccctgtggccaggactgttgaaggtgatcaccacattttctgagcttatggaagactggactcaggggcatccatgcagagccttcactgagctaatgagatgctcactttgggaaatctaggtggggatgttcctagaatcactggactctggtaagcttcaaggtcaagtaaaggaagggcccatgtcggccccactggaagccagagttgatgctattgaactgtggggcagcgttagccatgggccctacagagggagtgtgtgtggagggaagagaggagccagtccagagtccatggaaccccagcgaaagaaacagacagaagctgcctaatggccttgtaggtctagtcaggcctggctccctgcccagagggtgagactctgtggtcatctgcagcagaaccaaggcaggcccacaaaagcttactcatccaagtaaaggggaccctcctgcccagtgggtaactgcaagcatacagaacctccaccactgtggtctacatccaagtggggccaatgtgagtcagtctctgaagtggccccaacagaattggctaagttatcctcatacagctttatacccatttaagtatttattggcttggatacattatgcatgctaattcagattatacattcactttttgaaaactatcatcagtgcctgcatgagagaggggtggtcagataccatgtaagaagtgagaaggacaatctctgcaatcggctgtttttgaaaccttacagagtatttttccttcagtgagtttggcctgccctgacctctgcaatagttgctgttaatgggaattagatttgtaattcctcaaacactgccccttccttctgcttctgtcttcccatcatttttaaagtgccttattctgactcttcacacatctagcaatctgacccttttaacttttttcattttggaactggtttttattgtcttttagaattctacccccagtcttaaattttaaacaaacaaatccacatccagtcaactttctgaaatattttttgctgtgatagagaaggaagtatgatggcattcattgtttctggattaaagtatttttgtttgtattacattttatttttttagggacagggtcttgctgtatcacccaaggtggagtgcattggcataatcatggctcactgcagacttgaactcctgggcgcaagcaatcctctcatctcagcctcccaaagtgctggaattacagatgtgcaccactgcgccagcttatttctggattaagttttggcagataagagtgttggcctgtaagttatcagccaaatagtctttgactgtactgagcatgaagtcaaatcaaatcaatacatatgactttaattcaacaactatttattgaatagctattattacatgcagtgcactgggcactgtagcaagaattgaagattcttaacattacaccttcaacttcctgtctcataagttttcttgttctcttgctcccacttttcctgccctctgatggttctcatgacagtttattccatacactgtttcctcagctctgccctcttctcccattccatccatccctagtggtcttcacttcctcccttgccagcctaggagagacagcaggtcaaactttttttgttagccccctcaggtcccttgctctatgatccttctacctcactcactgtggacaatatacatcaaggactgatgctactgtccttctgtctttccacacagaggctgctgagtgtcgctggggatgggactggtgccatggcaaattcccggtgtccactcttggctctactcccaaagctgattaggaatagtatcatgggtctcctggttctgttccagctgccctaagccctcaagtctactccttatttctcatctagacttggttgggaaaacaaagtagtaaccaataaatatcaagtgaataaaaatggaatggtctctgcctctaggaatcataactatataccaggcacgtgttgtccactttaaatgcatgatctcattttaatctcaaacaacccaatatggtacggactagtctctggataagaaaacagacttttaaagaggaaataacttgtctgagataatatatttagtaatttttaaatttttttttagagagaagatctcactctgatgcccaggattatagctcactgtaacctggaactcgtgggcttaaggaatcctcctgcacagctaggactacaggaatgtgccaccatgcctggacaatttttttcatttttttgtagagatggggggtctcactatgctgcccaggctggtctcgagctcctggcctcaagcagttctcctatttcaacctcccaaggtgctgggatcacctgcatgagccaccgtatccagccattgttactaaattttgaacacagcatgttcttaatcactaggccataatgactgttcttatcacctctaaaacacacacacacacacacacacacacacacacacacacacacacacacacacagtctttcatactgctaagagtattatttgtaatatgatctttgttacctgattatgccattctttcactttaaattcttctcagaccctctacactttttcaatataatctaagcctttgaatgtgactcaaggtgggaggctccctgacccggcgtccatctgccagacagccctgtctccccaccccataccccacacagctcagctccagtgacactgggctccttgtattcttccccacatgccacattccccattgactctgtgtttcatgctctctaaaatactcacttccattctctatacaaattcttatcccttcttgaagagtaggtacaaatatagcctccttcttaaaatattccctgactaaaggaatcatggagatgataggcttcatctaatttacgatctagttgagaaaataaatcacataaacgtgaacaatcagcaaacaatacaagtcagaatctaatcaagtgctagattgtatggtacatgtcgcatatataatgcaccaagtgaaagcctttggaaaaaagaagtctggaagatgcaagagttaaggagtgtgaaaacatctcaatttaggaggtgtagctggctcagagcagcacattcttcaaagacaaggtttttaggacagtgtgcaattcctgttccatattttgttcaaatctaaccactttctcctctggctttttatatatataaagaattataaatatatataaatatatatatttatatatataattttttataggtttaggggatacaagtgcagttttgttacattgtgtagaagtaaaggctgggcttttagtgtagccatcccccaaaaagtgtacattgtacctattaagtaatttctcatccctcaccaccctcccatgcttctgagtctccaatgtctattattccattctttatgtccacgtgtacacattatttatctcctaagggagaacatgtggtatttaactttctttttctgagttatttcacttaagataatggcctccagatccatctatgttgctgcaaaagacatggcttcactcatttttatggctaagcagtatgccatggtgtatatataccacatttaaaaatgcaatcattggccgggtgtggtggctcatgcctgtaattccagcgctttgggaggctgaggcgggtggatcacctgaggtcaggagttcgagaccagcctggccaacatggtgaaatcccctttctactaaaaaaatacaaaaattagctgggcctggtgatgggtgcttgtaattccagctactcaggaggctgaggtaggagaatcgcttgaacctgggaggtggaggttgcagtgagccgagattgcaccactgcactccagcctgggcgacaagagcaaaactcaatctcaaaataataataataataataataataataataataataataagaacaattcaatcatctattggtgaacacaggttgactccatgactttgcaattctgaatagtgctgcaataaacatgagtgcaggtatctttttctttaggtagacacccagtagtgggattgctggatcaaatggtagttctacttttagtactttgagaactctccatatgtttttcatagaggttatactaatttacattcccaccaaaagtgtatagacattttctcatttctccatatccttgccaacgtctgttattttttgattttttaatgatagccattttgactggtgtaagatggtatctccttgtggttttaatttgcatttttctgatgattagtgatgttgagcattctttcatatgtttattggctacttatatgtcttcttttgaaaaatatctgttcatgtcctttgctcactctttaatggggttatttggtttctgaaattgttgagttgcttgagttccttgtatattctggttattagtcctttgtcagttgcataatttgcaaatatttcctcccattctgtaagtggtctgagtatttcttttgctgtacagaagctttttaatttaattgaaatcccatttgtttattttttgtttttgttgcatttatgtctttgaggtcttagtcatgaattctttgcctaggccaacatccagaagtttttcttagattttcttctagaatttttattctctcaggtctaacatgtaagcctttaagccatcttgagttaatttttgtatacagtgagaaataggggtctagttttcattctgcacatgactatccaattttcttagcaccatttatggaatagggtatcctttccccagtgtatgtttttgtttactttgtcaaagatcagttgtttctgggttttgttttttgttccattgatctatttttatgctagtatcttgctattttggttactatagccttgtagtataatttgaagtcgggtaatatgatgcctgtagctttgttctttttgcttagtattgctttggcagtttaggctcttttttgattctgtatgaattttcggattaaaaatatggaatgcttcatgaatttgcatgtcatccttgtgcaggggccatgctaatcttctctgtgtcattcccagtttagcatatgtgttgctgaagtgagtactcctcttactttttcaaggccttccatttctacctctgatatgatctttgatgatactattcagatgttggccagattgtctgagagctacagagttgacctccttgtttgtccctttcaactgctcttagatgttaagccactagcttatgtaagggaactatacgaaataggcatttatacttgctatggtttttactgtcgagatgttgcctgtctcagcaaagagtgcagtgccatgtggtaaattcctctcaggtgtcagtattaacaaaactgtgtgcttaacagctgcctttaatcgtgcaggtgctattactcttgtaagatgagtatgtttccacttcgagcagtgcgtgctccaccagcttgaataccaggaaggttatcaggaaaagctatggcaaaatcatgatggttttagtacttttccatttttatcctactatcattgtatttcccttggatgtttattacacacacacacacacacacacacacacacacacacacacatcatcatcatcatcatcatcatctcataaaccactttaatctctcgtggaaacaaattgtagtagaggtagcaaatctacatccagatacctctgtattatgtaaaatatgtcaatatgctttttccctcacttgatatcatccattgactgtgacaatggttctcaaactcgagtttgcatcagaatcagctggatgtcccaacgcatagatgcattcgataaatgttagccaaataaatacatgaatgggaattttcctgctcggtaaacaagatattttcatgggaaaagtgtgacaatttataagtaaaatgactatttttgtactgggaataacgcattgttggtgccagcaccgtacagagcagagccactgtgctgatggggaagtattggaccagcagttaatgaagactgctaaagcctgctttgctgtttcatccgcagcacacaggccgcatctgtcctggggctcatttgtccttcttcaacctcctccacagttagaggctcctgaactacaatggcaacgattgaagaaactgttgttgaaaagtccacgccaaattctcggtatgtcactgaagacaaggacattttgggtagaaccaggctgctaatccactcttgccaggagggaagattttttctctttctgtagtgagcaacaacgccactcggtaagctacagaattatctaactagtatttttgaatctagaaaaaatacaagctttgctttattaatgggcttattacatgtatgtgctgaaaacttgatatatgctccttctcatgcttgcaagtgtgacatggtttcttcccttttcacagatgaagaaactgaggttcatggaagttaaataacttgcccacagggcacaactagtaggcagctaagctaggacttcaactgaggtctgtaagacttaaagcacatgctattcctgctcctcaatagctttcctgctaagcaccaagagacgctaggctgccaggaacatcacagcagagaccaccgtcaatcaatgcatctccaccgtcttttagacattcttttgaagaaagatttagctgctaaaagaaaagatgaatatacaaaaaggataatactaccatatttcatcatattgtctcgttttaatacaagaagactcatccagcttaaacatttgatgtttaagaagctaaccagcaagctgccctctgggaatgcataccatcaggtatggatcagtggccctgagatcatgttcataactcagcagctttgtacaagctgtcaagactcagaacatggtaccccaaagtatggcaccttggtgtgctgagtactgtggactgaaggacatcggaaatgtctcagaagctatgtctctttgaccttctcccagcctcctgtctcctacctgtctttctcccttgaagtgagtcatggcaaccataattcctctttcccaaggtgtgtcacagaaactagaacccctctcctccaagggaagccgtgaaacctagaaaggtcactctctgccttcccccttctcccttgaagaccctcattccagaggggccctgccccatattcaggagggttacacaaagaggttaagaagaatttgaacattcaggccttgctgggttccctgctcagtctatcagcattagatcacaccctttagtccatcacatttctacaccgctgtccattcttcatcaaaccgaagaataaaaaaagttttccctgggtctttggatcttcatttctgaggagtcccatgttacataaaactttgattaccttcattatgcttttctcttgttaacctgtcttttgttataggagtgaccgttatgataggtgaggaaagatatcacacatttctgcccctacaaagccaaaaatgttggccgaggaatgctgctaagctcaaggccgtagctactcacaagcttttctctccactaccaagacctgtagatacaatgtgaataattttaaccttgatatagaagggagccaatgcagaaaataacttctcagttatccacaaaagctagtaaaagagctaacattcatgtattttttttcccaacaaatatttattcaacatctactaaatgacaggtacagttctaggaacaggggtccagtaatgaacacaattccaaaagtccatggcttcatgacaattatattcttgtgttgggagacagacaataaacaaatatattgtgtataaaatgttgatgatggtatcatgtcttaggtgatgacatattaactgccttctgtaagcaatcttttataaactctttgctgacttggaggcactgaaagttttacaaaaacattggcttatttatcaaagaggaagtatagtaaaatttgcactcattacaggttgagtaccccttatccaaaatgcctgggacccagaagtgtttcgaatttctgatttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccgcccgccttggcctcccaaagtgctgggattacaggcgtgagccactgcgcccggccgaatttctgatttttttcatgttttggaacatttgcaatttactttatttactggttgagcatcccaaatctgaaatgccaaaatccaaaatgctccaatgagaattttctttgagtttcatgttggtgctcaaaaagctttggattctacagcatttttgattttggatttttgtatttgagatgcttgaccagcaatatgttccagaaaatattagaaaaatggatatgtctctgtggtaaaccctgtcctaggcatcttatatgtattatcccacttaattatcacagcagccctatgaagcaggtactcttattatcttcatttcccagaggaggaaaatgaggtatgggaaagttaaataatttacttgtagttaatccaggaagtcagactccagagctcacagtttaggcaccactacactgtcaatgacaaatgttaccttttgtcactcaacacagtgatgggatgttaccaaggttgcagcatatggctgcataaattgcatacagcacagctggggatgggggtggcaagctgaccttgtgtggtgcagcaaatctgttgctttgctatcactgatgtgcagttaggcaatgtcctttaacttgaatataccttaacataagcataataagaagacaccagagaaaaatcacgctttccaacatgaactagaaataaagttattcatctattattattattattctccaataagacaataattgaaaccatggaagccatatatattccagagacatgtacataggctgactacatacatcatctacactttagataggccatttaaagtaaagtaaagtaaagtaaaggattctagcaatttggaggaaatgatgaacttctccatacaaaatgctcacacctctcagcttaacctgcagctttcaatttccgtatggccacttctcaccatctgcttatgttggcacagggtgggaggcaattcacttcattcagggaggcatcctacactacacttatgagcaaagacctgcaagtcaagtgaaagaaataaggagggggaaatgagcccacaatgaacacttcactgggtggcatcctatgggcagtctgcattgacaggtgtttgtctagcaacctccgcccatggcagcttttcctctgactgctgaaggggtttgcttcctttacccaaatctgtgtcaggaaaaaactccactgaagtatggttataagtttcatctcccagacaaataaacaagcagcctatattccagcagaccagatctgagtatgatcaactggcgctggcaagagtgcctgtggccagaatgagtggtacctgtgtaagtcagagaagtggctttgggcaacagcaagaatgttaaaaggatgttgcttgcaggaaaatcattaacttcatatttgaggaaaccttttggatgtttacttagggaatgagattcaaaattcgggctgctattgctttcttattctccttacactctgtatccaggtttggtccaatttcagaaaatgtccttcccattgctttgaatttctgtctagtttccttctaccatagcatctttaaccagaaggaagccatcttctcttactatcccactttccgccagtgtgagcttagaaatgtattgttctttttctccctctccctctgtttttctcctctggggaagcttggtaggaaaaatcagcgctataaattgcaagttttcctgctaagatccttggcgtatagctggctgctacttcacctttttaaaaacatgatcaacatcctgtgtcctgttagaattaggtaacttaaactttttatcaaggttgatttttgtttagaccctgggaatggctctgcatcatggcatatatgcaaaaacaaaaaacaaaaaacaaaaccaaaaacaaacaaacaaaaaatcctgaagaaataaattgtggagacaaatgtttataagtacaaatatgaactctgcaaaaaggattggaatccagtggcaggtagataagctgtaagactggacccataagtaatggaggactgtaccgaagaaatgtactctgtaccccaaagcttataaaataattgaacaggggatgtggaaagggaatctgatattggcaacacagcgtgtctctcctgtgagttactggaagtttgaggtaactgatgacaattctgtctgccctgataccgacattgttgtttctcatcagctccctcctcaggacccccaactatctctccactttccagcacagatgtctgtatttctgggcaccaggtcctttggaaataacactttagcaccttttaaacatttgcttcactactgagtagttatttgcacattattctgtcttccctcctaacgagaattctttaacagtcagacttgtttgctcagcaactaccccaatgccaggcacagagtgagcgctcagtaaaccctgaatgaataaaacaaaaggagtggaagaaagcctatcagcttgtgggctcatttttgtatctcataaataaatggatactccaagacttgtaaaagaggaacattatgcccttgggatgcaggaggaatcacacatgattgtgttagattagattgggttggttagaggaaaaaaagaatttggcctcagaaagctattttcttcaatgtgggagtttgatgtaacagaatcccgcctttggatattccttatttggtttcgggtactgataacaaaaaggacaaggagaaagatatttagaaatggtttaaaagatattctgtccaagccacctcgcctctcccatctccccctcgacctcgttattttccgtcctccaggatgatctttctaacttccaaatctgatcatgtcccttccctgcacaaaacggtctctattcccttcaaaatgacgactaggacccttgcgcagcttgacagcccctcgtgatcttgctgtgaacgccctccaccctcatccctactcccttctgctgctccctcaaacctgggctgcaaccaccaaacgacttgaagttttccttacccaccctggctccctgttctttacgactttgaggatggtgcttacgtcctccacttaagcaatgcccttccctgcctacacagctcctactcatccttcaaaatttaactgctcctctgcccaccatctctcattcacttttcacactgagctctgtccaaatctagtaaggctctgcaattgtctcctacactcatttccttccttctcatcctctcttctcccactgtggggtgaccacggttacccgtaaggacaatacactttctgctttacaccccgtccactgcttgtcaataacaagctttataatctcccaatactataaaagctgaaccacatgaaggaaccctggagctggttccctagggatgttggccaccatgctgctggctgtgagacatgtgattgctcacctatgtcagcacatagatatggtgagggagaaggatctgacacctgacccacagtcccctacatcctcatgggtggcaatattttaccacctacatggggtattttcactttactttaacatttctgcttagtctaagaaatctccccctccttaattgtgtttttcagaaaaccaaatgggttattacattagttctgagcaatgagagggaagcaatccatacatatggagtggcaattaaattaaaccctagaattaggatataattcccaagtgaaaatgagctgaaggagaagtctaataggaatgcctcaacctctcagttggccaacagacccctaaggtgtccgtggtactctgagatttttcttctcacactttgcaacattcatttgtgggcttgtctttccgctccaccaagctctcagagaataaagtgaagtgcatgtctgccttcccacttcccagcacagtagctgcctagagcacagaacctcaataccagcattgaatttcacagtgagaaagttatttccatttccattctcttttaatccttttagttcaggcagagcagaaaaaattgattgtgtattttgaacaccccttaacatttgtttttcctccctcttaagcaggcttcagtgggcacagtatctacctggaaatgagtaacttgctttgttttccttgttctttttttaaggttaattttatcccaaatggcaaggcaaatggaagtaatatcgagttgcttttaacaaatgtattcaaataaaactaagtctatttgtggaaaactattaagttaaaatacaacatcagtagaaatggacctggccaaaatcatgatgatgctatataaaggatgagtgtttagaaaacactggcatacagtaggtgctcaataaatgctcatttgatggataaatgaatctctcttccatcttctctcttctttcaatttctataagtttcacaatagatctggcttggcctcaaatttgtattactgtacttgtctcatattctgagctatagtactgtatctgctttctgctcggcccccaccgtgcattagcatgacctactcataaatgtgccatgtttcttttagtttagctttaaagactaaaactaaaagacattttagttttagtcagacattcaaagtcctccagaagctggctccaatctatctttccatgtgtatcagcccaagttctcatatataaactatgcatatatttgtgatttctagactggacactagggagagtcttcctggccttgagccttcctctcagtgggaagccctcagaatcctacagaccttttaagactcattcaaatcctgcctccatgaaaccttcgctgagagtgatcagctctcttaattccagctgagagtgatctgcctctcttctgagacccagaagcactttgcctgtgaggaaacattcaccatgtgtacactgtgtttaagatattcctttagcgccctgtactctcttttcaattgcacgctcttggaaggcaagaaccagttctcatacatctttctatctctaatcttgttactgactgaattaaataaatgaatggagatatttggggatgtactgagggaaggaaatatggaaaaatcaatgacctgcttacagatgctacctgagctgaagaaatgaacagcaaacccagtagaaagtgaagctcactgggaacatgaacgtggtaattgactcaattagatcacagaaacctacctccttttaataaaggatatgcaatcgtatttttaaaaatatttttcaaaaaccattatttgtaattaagtccaaatccctccattttagaagcaggaaaattgagataacattacaagcataatgtatggacacccatggatttacgtatgactagcacagtattcatgctgcaaatatgcatggggaaaatggtcctagggttcttttgcagcagatcttttaaacctcagatgaatcacactataaaattctcttaaccctagacacaaccacaaacaataagagccatatttacagcatgtatttcactccactgggtctaatatttgttggatgttttataggaagaatggagaaatctaagatgtctgtgagtttgttaggttgaccattcctttcagggggaagtgatagtaccatgaaaaacattttagaagatcctcctacaatagctgactctaacatttaatttgttgttttgtttcataccagatgcctcattggaaaaatagcaatattgaaatggcaaaggcagcaatgttagtaacattagtgtttctagaactattctgcaaaaaacaaagagacactatcctggggctgaatactggcctgagtgagtctcttttgcatgatctcctagagagatgggttactttcgtaaggaaacatcattaatcaagcctaaaactctgggcttaaggaaaaattttccttcctgaccctagtctagtgagaatttccttctgttccttttacaccatcaacagaattgagaagatgcactctcaggagcatttacattaagtggggataaatcccctaagtaaccaatggctgtgaatgatagcatgttagactgatctcctttttcaggagattacccagaacaagggccaaatagggcatgtagcactgctccacagcccaccaagggccaagcagtgcaagatcaggtctagacgagttttgatggctctgtggtcaatagtggcgatgtggtaggtggcactaaggaagtctgcaaacactatggcaatgctggcttggcttcagaatgacataaccctttagggaaatagaattttagaagttgggtttattcttatgggagtccttaagcctggggttaagccaagacaaaatgtaacccgtgggtttcacctagtcccgtcccagagcctaagtctatggagttgaactgtaacagcattgatcatcggcattcttggacttaccatttggtgggtttttagtgatgattaaagaatctattcaaaccaggagaaaatgctcctgatttcctatagtttaaccacttaatgaatcagtgtttgagggacacacagccctcataattaaagcaaggctgttaagattaaatattttatttttataaaggaatataattgatacaaatgttaattgataatgtttgaaaatgcttttcactccttaagaaaccttaagatcactccgtctttcaagacttactttggatcttgctcacttacatcttgtacataaaatataaaagtaataaaagcatgtaccccactcatttggcatagtagatacattttctggactactgaatatgcatggctttgtagggtttctaaatagaaaccttggccctattattcattattattattattattattttaatatctattccattttctctatctagttcttaccctgacattagaaaaataaaccaggatagttgaaatgtacctgaataggccgggcatggtggctcatgcctgtaatcccagcactttgggaggctgagttgggcggatcacgaggtcaggagattgagaccttcctggctaacacagtgaaaccccatctctactaaaaatacaaaaaattagcttggcatggtggcagatgcctgtagtcccagctactcgggaggctgaggcaggagaatggcgtgaacccgggagttggagcttgcagtgaaccgagatcacgccactgcactccagcctgggcaacagagtgagactccatctcaaaaaaaaaaaaaaaaaaaaaaaaaagaaaagaaatgtacctgaataaagggaagaaccaaaaaaagtataaagagaattgggaagtcacccttatcaataccatttccgtacaaaaatttgtttataattaccaacttgaggggtattcattacttggtaacaaggaaacatctaaagaaggctatggtaactctccctctttcttccttagttcaaggttttgccttttaaaagttattcccattgcccctctggaaatttcgaatcaattgtttgttaaaagttttaatgagacaatgcgataggccccagctaagcagtgaatttcgaactagaaaaggaccataaaaatagccatgtcagaagatccccaaagtgtgttatgtggatctctagtcctgagagatattctgtgagaagaggtttggcacaatgtgtttgggggaagctggttatcataatcctcacttagaggtacagcatgccttactctacaaaagggttcgaagttttgcaaagaaagcttttgaatggttttaccacagcattttgcaaaacagtctggtccttgaacccttttgaagagtacctctagccattgcttgaaatgactgctatgactgttctgcaaaacatacctgaggaattgcagaccaatcccaagtccctccttttatagattaggaaacggagtgtgattcactctcctttcacctaatccgtagtttactcccaagaatcttgggtaagtgtggataacaggcttttgaaattgatgtaaacttagtccatctttatagtagaaaagaactgaactacatctcggaagtttagctgatttatccaaggttactaattaaccagggtctagaaaccagaatgtcttcacttctgctttgtcctttgcccatcagaaaaatgctgttgtcatgctatgggaatgcttttcagaaattattatagcttgcattttgctttatcttatcttgagtctgttatttttttctctcagtatagttgaagtcctttcacaaaattccacctaatccactcaccagcttaagggacactctttattccccctgaaaacacagtcaggctgcctgaagtacaggaactctcacaccaataagctattctagagcttttctagacgtttcctcaaatctatttatgttagtgtaatttgaaattataattacgtaatttaaatgttacaaaaagtgctgaaatatgagtgcagaaaacaagagtcatttttctaaaaataaaatggtaagctgtgtaaaggttggatagacatgagctgttaaggttgctgccaaagtagctgtgggtgagaccaatgtaaataattggaaaaatggtgaaaatttagaaagattctggactcaaattactttgcatgtctacatttaaataaactgacattggaatttatagataacacaccatgagtgtggtttacgcaagaaagagaacttggaactccaatcaatagattcctttaaaaacgacaaccaccttgtttcttcaagaaaacattagcgaatgaatatacgtttgtattttaaaaaaacaacaataccgtaatagtaatacaaataaaatgcaattcagtatagcaacaatttatgttgtattaagtattaaaagtaatctagagatgatttaaagtatatgggaggatatgcatatgcaattatatgtaaatattataatactatacgattttatattggggacatgagcatccatggatgttagcgtcagtgggggcagggcgggggtcctgggaccaatacccccccaaatcgggtgactgcagtttacttcctgatacagtattaggaaaaccaaagcactacagtaatatattctactctatttgatctttcctagcctatatcctcttctgtttcacttaaaaatgctggccatgaacactaaattatttcttgaacctcagtttataaaacaacgtataaataatgactggtgctaccagaaggttcatatctcatcctaccaactcctagggtcaatacctggtgtggcaatagaaatacccagataaaatatgtaaggaaactatcccagatctcttgcctaaattccaagctggggaagacagcaagcctgtaatagaaacctccagtgtaggcttgattcaggctggagctgatgtggaggatgagtgacctcagagagcccctcacttcttggctagaggaggaaggaagaggtgaagattccccagcagttgtaaacatgcaggaagaggcatgtgggtgggcatggaggacacaggtacacccacttcaagatcaaaggctgtggaagagaccacaggtgtcatcaacagttgatcatatagaagactcgaaggccaggctacctctcagcaggtgccaacgaccaggagggatgagccacagatcagaggccagcgaggccaggctgtgaggacgtaacccattcaggatgctcagtgagcctcccagcaggatggaagaatattcagtttcatcaaatatttatctaaaagagacaggcttcatggcagcacaattctgagttctatgtgttgactgtaattggagccttaagagctaggtctaacttagttgtagaaaccaataaaaagttatgcccctgcacatataatctgtgactgtaaattttcaacctgctatacctgcactgaaaaaatttttggcataggaaagcaatgtgcagttcctgctgttatttttaacagtcattcagtgccaatgttctaggcattgtactgaacagagtaggacagaattccctgttcacttggctcatgggcaaaatgagaaaaacacaatatacaaagagacagtgtaatgggggagagggatatatgcatgattatgaatgtggcatatttaagaggtataaataatctcatgatatattacttagaggtagttgccatataggattaaaagtatgcactcatagtttaatagattaaatatctcaaaaatagtgcataactatagaattttgctcttaaatttggcgagctgtgattcaagatcctcatcagtactcttgaaaaattactgatttctggcccccattcctaaaagcctggggtttggcctggtcatttgtattttcagaatgttctcttgatgattctgatgtgcagttcaggttggtggccactgtcataggaggccatgtgtgtttttaatagatacactatttatgcttgcttataagtttatctgccactcttaagaagagtgaaataaaccatttaggctaactcacaaatatactttttctccataagaaaacatccttaaacatgataagattagcaggtaacatccaattttgcactgattataatacatttttagtaaactacgtgaaaagtaataaacctacaaaaatgtgtttgaagtatcatgccaggggtaacatgttcctaaaatctagactaataaatatgaagaggcaaaggcttgcatatttcagtctgtaaaatgcttacagcacagtaataggacccctcattcatcttcttctctactgttctggtcacaaggtatagtttgtgtttggaaaatcctagcctgggttgctgaaatcagtagaaacaaagcatactctataaaaatatggtggtgatatttagaatcacaagttagaaatgaacttttctctacattggaaaatctaaggaacagtgataattttataccaaaaattacctgagtgtttgttgccatgacagcctttagtgataggaggcaaaaggtggtaaaagtagtttctgtcctaaacagttgaaaccaattgctgaagatctttcctaagtgagactttctaccataggtaagaaagattgcttagggtcatggcctacaggtttttaagcacctaagttcccttattcaagactcaagatcccaaaaacaaagtggttaaagttaaggtttcagtctttgacaataaagttaacctgcacttttgtatcacattaatgccactggtcatattgtgaaccattaactgcaatttgtaagtctcaagctgtgttccaaaagggaccgactgtctagtactaacacccaagaacactggatactaatttgttgatattattgattagggttcttttcttgcttttgatttttttattaattagtgatgataattacttttatttcactgagatagtggttaaaataaaaactctttctctctttctctttctcttgattcttcaaataaatagtgcaacagtcaatagacggaaaattctttgaacagcagggatcatatacatgctctatttttggtgtctttccagtgtattgcacaccactggttggttgttgttgactgcccatcttaaaagacactttcaatgaacttcacctttctatttacctagaattctggaaaactccatattagattattacctacataattttctcttgcctagataatatgtttaagcaattttgagtttttgagaaaaaatacactccccacaacctatttttaagtcaatttaagttcaggaatcacacagaaaaaactgcagctttcttgatctagtgtcatttcttatgggttcaatgagaagttcctgagagtgtccttccgagaagcataggaacaggaagtcatcatttgccatttttttcatgattaaaaacttttacaagttaatagttggactacgaaaatgaatacctgctgtcggctatctagtatccctggctaatattaaggaataatgaaaatatcctctttccaatgagcatgtggattatcacattattattcaaatgctaaagagagtcacaaaagcagtgatttggagttttatcttactaaactgaggatagctgtctccctacatctccattttccaagtagtgagaaggtaatacatttgatggcaatttctgtattactactattatccactgcagaatgagaggaaattaagagagagaaatttgatgatttaagacaaagcatggagagtgatgtctggatttaaggaaacaaatgaacaagtagtctgagaccaaaattttcatccattaaagcctgctgcttcctataggccaaattcaaattcaatagccatttagctaggacaaaacagaaacatttgggtaggtgacctcaggtgaagtgaagtttttccatcttcttagtgaactccagaacaatgaaaactgaaaatggctgcttggcaaaagggcaaaattggcgattcggaatcattgccatctgctagtgcctgcctttgcggtgtccgggggaagttgattatggagctgtatttgtagcaagcttcaatggagtgactcacctcctttcttggacaaaaataaagggttgggaagggatacctcattttctaaatatataaaaatattgcagaaaattagaataggaatctttctgatgacatcaacagtgtctaaaaaaaatgagccaccaacagagaaggctgggtggaggtgggacaagatttctataaaacctgtaaggatcattgcttgctgggaattagaaggagtcatagttctaatcctggttttggcccacgaactgctggaggataagacatttaaacactctagagtttaatttctccagctgcgagttgagaaagccttagatgagtacaaacagagcaaattcctgttagaaagttttagatggtaaatgcctatcaggtaaacttgtgttctccctgaggacaaaagcgttgactgggcacctacttcgagccatgtttagggtgcagtttttgtgcagttctttaggatgaagtctggatcttatacatatttgattactttttgcacagtagttggcttatcaactgtaatcaataaaatttgttgaatgaattgattttgcataaattatctcaaatgaattaaataaaccctttttctgagggtaagggaagggaatagaggtattagtcatgcaaataaatcaagattggatctttatttaaagaaagtttcttcttttcccctcataattggaactttcattttatatgattatcaggagaaatgtattccctagactctgtcagtagatggattagaacatttggaataactaggaagttgtttgctcattttcaagttgttcagtgactagaatatatctcattgtggggtgtgtggtgacatggtatgctctagctaattgaatcacccagcaagggcattacataaattttcaatcctacagaaaagcaatccaagtcagttttctaatgagctgattgatggctcttttgtgaactatttagcaggaactgaaatgaacaagacttgattccttttactgaatcatagcacttctccttcctctcttattgcagctgggctgccaaagatgtgaattgatacatctacttagctgctataggctcagcatgtgccagaggttgaatatttacttaatgtcaaattagcatacagcagtgaaaagtcactcaatggcagttggttatcaaagtgggtccctgggcccacagcagcagcatcacttgggagcttgttagaatgcaaattctcagattcaagtcctgtcgaatcaaaaattgtgttttagtaagcgcttcaggctgatatgtgctgaagttttgaaactgctgatgtatggtatttaatgccccaagaaacaacaaaggatttattcttcttgactcatttatattttggaaataaagtttgttacatattaatctgttctttatggatatctaaactttaataaaccaaaataagatttcttgtgctcccaacaactctaatgctttacctcatatgttttgttgttttaggtgagacaatgtcaattcacatcaataactgttgtcagagcacctactgtgttaagttctgtgggggaaatgcaaatgaaggaaactcgctcttttcttttagggtctcacaatctagtcggggagactgacctaatatgaggcctagtgtgcgaggtttattctcccaggtactattacttattatgagcctattatgagatgggaactagtctaggcactggagatagctcagggaacaaaccaaatacaaagcccttccctcagggagcttacagtctagtggaagaaacagaaaataaacagaacgaacatgttagaagaataaacatatatttaaatatataaatacataaaataaatatctggcaggtcacaagtgctctggagaaatgccaaaccagggaggtgataggggcgtgcctctgatggaaacatatggaactgtgggaggctggtgtgtccacaagcgtcctgacttgctgaggcctcagctctgtggctgggtaggtgaatttgaccaagtcaaattttctttccatgtctttgtttccttggttctaaaagagtctgaggtggggctaatattgtgatttgaaaaagtcctttggtgactgtgtagggttgggtgtggtgggaagccaagctgggggaactctgtgtttcctgctccatccagaaccataagctatttatagatcagccctttggtgtaagtttttgtttgaaaaaatgttttccacagctgaagaaaaaaaataaaccactgaactagatgatctcaggtttgtaccagttgtggttctatagtctttacttcttccttaggattccttagtgggaagagatactttgttttttgttttgttttgtttttgagacagggtctcactctgttacccaggctggagtcaatgcagcctcgaccttctgggttctagtgatcctcctgcctcagcctcctgagtagctgggactgcaggtatgcaccatcacacctggctaatttttaaatttttttgttttgagggggtctcactttgttcaagtggtcttgaactcctgggatcaagcaatgctcccaccttggcctctaaaagtgttataggattacagacgtgaaccaccatgctcagccagaaagagatattctgaattatttgcaggaagctgttatggaactacaggtaaaatggtaaatatttctattaaacatagcctctgtttatcactctacatggaatataaaaaatttctgaattttccttaagaagcatatatttactttttctactttctatgctaatacaagatcagagagaacaattacttttctatggctggattgaaatatagattcttttggacttaaaatttcagaatagatcaaatctcagctgacggaagcaaaatatctgatagttttaggttctcattaatattgctccttaaaactaagtttcactctttagttatctttctatgtatgaatatactatggctgaaaatgatgtcttctccctaatctactacggcatgtcttgctagcttagaaacattgcatggatgttacaaggaacattacatgaaacattacaaggttgatatatatttttccaaacagaaaccaaaagaataatactgaactaaatgacaaatgggaaacctgttactaatttgaactggaaactgattacattttactttcacagctactcaccaatgctgccttaatgaaaagctcttccaattgtcactatggctttctttttccccaccataggtaattttattttattttatttatgggtggggggaatatttaatatctattctcttagcaaatttcaagtacagtggagcataggttaactatagtcatcatgctgtacagtaggttgcagaacttatttatcctgtctaactgaaactttgtatactttctgaactccccatccttccctttcccccaggctctggtaattaccattttactctctgcttctacgagctccagtcttttggagtccacatctaagtgaggtcgtgcagtatttgcctttctgtgctgggctttctttattagcataatgttttccagatgcatccatgttgttgcaagtgccaggatttctttctttttaagactgaatagtgttcaatttttaatacataaaccacattttctttatccattcattgttgatggacacttagattgattccatcttgtgaataaccctgcagtgaacacggggtgcagctctcccttcaactactgatttcatttcctttgaatatatatcttggaagttggatatatcctttggaagttggattactggattcgatggtagttttgtttttaattttttgaggaactcctatatgattttccatagcagctgtactattttatgttcccaccaatagtgtacaagggttcccttttctctacacccttgccagtatttgctatctttcattcttttgataatagccatgttattattattttttgagacagggtctctgtcacccaggctggagtgcaatggtgcagttttggctcacagcaacctccacctcctggactcaagcgatcctcctgccttccaaggagctggaactacaggtgcatgccatgacacctggctaatttttgtgtttttgtagagacagggtttcgccatgttgcccaggctggttttgggcccctgggctcaagccatctgcctgtctcagcctcctaaactgctgggattataaacatgagccaccacattcagctgttaatagccattgtaacaggtgtgaggtggtatctcattgtggttttagtttgcatttccctgatgactagtgatgttgatcattttttatatgcctgtttgccatttgtatgtcttcttttgaggcatgtctattcaggtcctttgcccatttttaaactgggtgatttgtttccttgctctggaaactatggcttcttttaataagaattttactagttttatcataagctgagtttaataagctcagctgtgacaattatgtataaaaataagagaatgccaaaagcacactagctgagctttagtcaaagtccctgtgaagtgaacctcatgcagacttaaaatagtgggtgacttggtaaagtggcagttcactgcagtgcagctcatggaaggaggggcccagttatgacttagcaaggtaattgaggagattaaaaaggaacaaagatggaagctgctaattgcaacttaaaaagggcatttagaacctaattccaaacataagatatgattgatctgttcctgggaattcttttgtgcacttggagggttttaagatcaattaaatctttgcatcttaaaaataatgatcacaaggaagaagaaaagttaaaacaaggaaaacagcatactggcatagaacaagctatttctgaaatatcagttacatttggatgcaaaatttcaagttttcctttttgggagaatgtcatctctctgaaaacttattttgaaaccttatttattttttttttcttttcctgtagtcttcctctgtggtcatctgaagacatcttactgcttttaggaaagaatagtaagtcctgacaagtcttagaccttagatagatggtagttctatttttaattttttgtggaatttctataaagtaaaagtcaatgaaaacagagaaaattccctactctactatagcaagatgcccatcagcagaaaaggacagtgtagaagcagattgacactgaattatggtcacccttgctcaagtaaacaaattaatatccccaaggacatccataaggcttccctctcaacatctgagggctggatttgctctctgctgtccaccacagactatattcaactgctggaaccttgtctggtgctgaatagcccaaggacagggacgctgcttcagagacacccacggtcacagttgcaccagccaaatctgtttttgtgcccgtgtcttctcggagaacagagcagcatatggacggcttgggctccctgccatctgtcaagagtgggcaggacagcacgtgcaatcccaatctgcaccaatgcttggtagataacactttccacagggaaaggtctgctggcctcagataagaacagctttcaaatggggactatgaaaaactgtacaacagtcacaactcggttccactcctctcagatctacctaaagctctcatagtcataacctatatgactttgagggaagaaaatcctgacccattgctcagttggtatggagcttgaacattcactcacatgctataatatcatgatcatcagtatcattataaacaacagcatttactgaactgctaccctggaactcttccctttagcttctaagaacatgcacaatgtaatatcttcaccaatgagacacagacctcagagtctgtgcttgcaaccattaggcttcaccgcctcctacctaatctaggagctgatgtttgtagaagggtgtggggaatgagctgatcgttgtagcagggatgtgcatggaggagagggtggaaagggtaggaagaaacagcatagagaatgcatcaggatgttccatgttgcacatacactatacagacagttcctgatttatgatggtttggtgtaggatttttttgactttacgatggtgcaaaagcaatacacatttaataaaaactgtaccttgagtacccatacaattattctgtttttcacttttggtacaatactcagcagattacatgagctagtcagcacttcattacaaaataggctttgtgttagatcattttgctcagctgtgggctaatgtaaatggtctgagcacatttaagtaggttaggtgaaggctaagctacggtgtttggtaagttagctgtactaaatgcatttttgaattaatgatattttcaatttacaataggtttattgggaaataaacccgtcataagttgagaagcatctttactaaatttcccagaaagcaaatgcggtgtttgttatagaaggcagggatttgcattaggggctgaggaccctgcagacggcagtcagcagcattccagctctcgcacccatgggttacaaagggaaagcactggacgtgagtctaagagtgatggctaaagtccaaggaggccaatatccatttctcagtcagtttgttgttacctatgtgttctcatttctggaggagtcagctacaatattactgtatatgttatataatatttgacatcattttatagagtaatgatctacactagaatttataaatgtgagggtttgtgaagtcactaggcatgtactgagtaaacaccaaagagctgctctattcaaccatcatttgctatcaagtaaatttcagtataagtaagagaagactggctctgacaattgtgaggcatacgttggatgattttttaatgcagcattatagatatgtaaggctatgtagtaaatactctgctagagcgataatgatcattttaaatttgcttatattgtgaaaattgtgtatatgggagagtcagtacctaggggaaaaggaaaaatttcagaaaaaaaactaaaataagcacgtttttctttatatattgtggatatgaaagggtagtggtggtggtgaagactgtagaaaggagataaagaaaaggaaaccaggttcaaggagccgctgtaccccactccttggctctccctccttcataatcatcagcagttgtactaaaaagaaaggaatcagttttacaagtttccttaaatctgacaatgaactagaggatcttatatagaaggaagtgctaggataacattctgaagaatcaagattgcttgcatatttgcatttctttggttcttgcaatcatctctctattcaagctgagctgtgaaatacaccatacctgttattactgggctagtggaccaaatatgctttgctgttgttattccaatatcgtgtctgttgctatgaaaatgaagccatccagactaagatttcaagtacgtaaactgaacacggtagaagccagcacacagaataattctaattttgaatgagtatatgccaaataagtcatttaacctttgagtctcagtttcttctgtgaaataaaaatactgtgctagacgttttccaggctgtttttaacatataaaagttaggtgagaagagatagaaaccaacaaacaatgaaccaaacacagacatcaaagggggaaaaaaatgccattcagggaagtgaatcacagaactttggattcaggaactagaggtccctggaaaagccattaaatatgtttctggagattttccccctaagttttctctgaaagaatggtttctacctgtgttatgggttgttccagggactggcattctgagcaaagactacccttcctggggatcgtgggcaggaagagaaagtggaaggagggcaaccaagaagttgaatgtgacgatagaccatagatcttagtgatgaggtcttgaactagggtggctggaggcagagactggaaagaagggggcagatggaagaaatattgtgaagctgaagttggaagaaagacaaagctcatgaaagatgttgcaagcactagagatgcgtagcttaggaacctgtacacagggcagcctaccagcacggatctacacaggcttctcaagagatacacacagtctatcggaaaagtgacagaaaaaagaatttggatgctttgtgacatgcacagtccaatgagaattttgtcaaaataacattaataccatgtcaagaagacgcctggatataggtaagttgatcaacaagaaagattggtcaaatggctttgacctttttctggcgcttagtttcataggcattttgggtaattttaatctcctttgtaggcacttgagaaacacttgaaattcacacacttcgaatccttacctttgtttgaaggtacctatgggcaaatttgtaacccttagcaggcaagggaacttgataccatctactgacatttcaaaattttcaagtgcaagggtagcagtcctttagttcactaaaaatgcagaatgcatcacaaacaaagcgtatagattcctggtgagtttaactgggagataaaactgaaagttaggttgaggctagtgaatgactttacattttggatttattggattggtaagagggagctacggatgatttttgcccaaggaggtcccagagccatagtactactttaacaagctaatatggcagtggtggaaaaatccagtggtcaaggtagaattcttgagtcatgctataaacaggaactgcctgaaatgtgctaggtattaaggtgataagttgtaatagctacaagtgattgcatgttatcacaagccaggcactgtgctaagtaaagtgcttcatctatgttatttcacttaatcttgatagcagttctacaatattatcactagcattttatgaaaaagtaaatggaagctcagtaaatgtggtccaaggccacacagcagctagtaagtgacaaagccatggctgaacttcaaatctgtgctctcagcctgtaagctaagaaagggacaaagataagaaagagtgaacacatagcactgtgaaacagaggcgcagttagatacaactgcctgggagactacagtcatctcccagatggattttctgcaggatgttatagacctgagaaatgaaatcttcctttccacatcaaacaccttgaatgtaaaaaagcattttaaaaattcactgggcccggacacagtggctcatgcctgtaatcctagcactttgggaggccgaggcgggcagatcacttgaggtcaggagttcgagaccagcctggccaacacggtgaaaccccgtctctactaaaaatacaaaaattagccaggcgtggtggtgcatgcctgtagtcctagctactcaggaggctgaggcacgagaatcgcttgaacctgggaagcagaggttgcagtgagccgggggttgcagagattgcggcactatacttctgccttcagcgactgagggagactctgtccaaaaaaaaaaaaaaaaaaaaagcactgggtattttcctgatctgttttcgtgatgtgttatataccaggttaccattagacttactaaaattatagtggagcatcttcaggtttcctacctcccctctgctgccaccgggcatgttcagtttatgccccactttttttccagagtatattcagtacgtctatcttcacatttctcaccccttaatttttccccaatagctaggaggtaaatatgtttgcattgcatctcattgcattgcattgccttgcacttggcgttcagttagggcgaaactctctctctcccactccgctccacccaaggatacacttcaaggtacccaggaagcaatgtctactaatgtaaaaggtcttgttgacctgacagcgatcaatacgcacatcttatttccagaaagaattacttcttgttaattgcttcccattttcaatagtttcactaaacattgagagctaaagtctgattcatgttaggaattttatgagtttttatgtttctctggcaaaactgaaatgttcaatgctggtaactgctagaaaggattattaggtaacttttgccttttcaacaacagctctcgccatcaaaaatccaacttgtatgtttataaaactgcagttctgctacatttataatcacaacatggccaaagggattatttatttttccaacatagtaatgtaacttggaatgattctatagctcaatagaagtagacagcatgagcctgggaagcattcttttataaatcacaaatgcaaggaaagaaaattaaaccaggaactctaacctgggtttttgttctagcttggtcattttctacctgggcaatcttgggcaaggcgattcaatattctgaaccccattttctgcaattataaaatgagaagacaactttaaagtcctgtaagagtttatttatttgagaaaaaaaataaatgggtatgtgtgcaaagttgtttcccagagcatgatggtaaaatcaccaccagagaaacttaaatagtgcctgcagtatctacactagttagaaagcatggtgtggtggaaagaacatggaatgtagactcagaagacaggtttgaagtctggctctatccaattctatatataagaactagagaatgtattaactggatgagtttctagtaaaaaaaataaaaaatgcaggaggttaaatggagaccatagctagacaatcaaaagatatttgtcaaagcacattgcaaactggaaagtcatgtgtaaatgtcagaataaattagataaactcaggtaagccatttttagggtcagaagagaacataagcacagaagcacatgttgtaaggatttaaataggtcatagagccaactatttcctcatctagtttctgagctctgctatggaggtaagcaagctcagtatcaaaacagttaatttgcaacaagtaattggaattaactgtgctaatatcagctttaaacttgatgaacgtcaggtggctgtgagacccagcaggagacgaccagcacacagttagatatgaggttctggagttcaggaagagtgctctattgagagatctagatttggaaaattatagcatgagagcaggacagttgccgcctcagacctgaggggatgccaacatttaaagcaagaggcagaagggctcctgcaggagacagggaattgggaaggcagcaggttaaaatgaggcaagtggtcatcagtagcaaatgccacaaataggaaatgtgagatcaagaccaaaaaagaacatttaatttgacaattgggagattgctgagttcctttatctgagcagttttgctgcagttaagggtccaaaaaagcttcgttttagttaaataaataataaattaaaagaaaataagtgaggaaaaacaggtttgacaattatttttaggatcttgacaatgaatgaaaaggagaggtgcccggcattaagccaggcactagggatatgaagtctttacccctggagaagaattcctcagtaatagcattgtcatttgtgcgtgtttaagatgaaatgctcatgtattactctctagggataaaggaaaaataaagctacaatctttggattccattccccattgttaacggtttttcttttgtgtcatgcacaaaataatctacaacttgttttcttcacttaatactacatgatcttggacatattgcaaatcatcaaaaagaggttcaaaataattccttttaatagctgcatattattttaccttctggcttgatcaggatttatttaactggccctttatggaggaatgttttttgtttctagctttgtgctatttgaagtcatctctcagttattttcatatatatccatttccatgaagtaaattactacaaatggagttacttctgggtaaaaggatttaggtagcttcagatttaataaatactgtcaaatttattttcaaaaagcatgcactaggccgagtgtcgtggttcgttcctgtgatcccagcactttgggaggctgagcggggaggatctcttgaggtcaggagtctgagaccagcccagccaacatggtaaaaacctcatctctaccaaaaatataaaaattagctgggcgtggtggcgcacgcctgtggtcccagctactcgggaggctgaagtgagaggatcacttgaacccaggaggcggaggttgcagtgagccaagactgtaccactgcattccagcctgggcgacagagagagaacctgtctcaaaaaaaaaaaaaaaaaaaaaagcactaattttgctcccactaacagtgttcatactgttcattgaatagtgttcattggagaagaacagggtcttctccagtcttaccagtcctgggtataataaactcttaaatatcttttggatgaaatcagtatcttatttgatttttaaaaaatgatgtcttgttttaattttcacattattataaataagactgaacaacttttcacatgtttatttgccgtttttgtatttcttctgtaaactttttgtttataacttctgctctttttcattaaattaaaatttttatttgtaaaaattcattggctttatgggaaattattgctttgtcagtcaagttttacagatatttttccagtttaatgtcttttttaacttgtttgttgtttttatgtagccaaatttataaatattttacttcaaaatctggtttacatcgtgtttataaaagttttcccaactttgagtttaaaaaaacatcactttagtttccattttttaaattccaaagatgattccttaatctttggtgataccaatttctatcgtgtgtcactcttgctatctggaagtataaccaaagtcccttacattcctctgtactaaaacagtaatcctgttgttttggtattaacacatttttgaataaatttttatcatattgctgattcacttttagaaaggagaatcataaaattacatcaaagtcgtggcatctaagttagagacaaaaccagtatcttaaaggagatggtgctggtgttgagtcactatctaatgacgactcaccaagcaatcctgcttactgttcagctcaaatgcactggagaaaacatgattctctaaccacatttgagagttcagccacatgtagagacatggaaccttcacatctttcctctatctgttgtttaaaagtgtcagtgatgtcacagaaataactatttcatggagtgtcactattacagaaatagtgagcctggcagaggctagaaagcaaccgactctctcacgtcatattagctacatcgccatagaatcactgctgccccagtggaaagaagtgaaaagcccatttatcatcttgcatataccctcctcaatcagttgcctggaaaaccatggggaaatataaaaagcttttggttgaacagttcagaaaacaaaaccagttccactacactctcccaggtgtggtgccctaggtccacaccctccacttcctcccccactgccaccctattctctcatgaagctccctagattttctgtttatgttttccttctctttcaagatgccaacattttctccacaaagcagtttactaagtcaatgccattagcatacacaaatctcaagttttgggggaaaaagaaaccctacaaaaaacccttggaggtgaacttgttcatttcctcccctgaaagtgtgaattttttcagccgtatccccataaggtgctacccagcccttttccccacattgatggtgatgacacatacttgaccttctgatgcagccaaatctgtttccaggcagtactaattataatatagttactttttccaaggaactgaaattggaatcttgcaatttctactctttagttttacttctgccagtgggtgtcaaaggtattgtgttttgggtttttgtttgtttgttttgcccaccttttgcttgtactttatggtgacatctaacatctgttcttgagttgtagatggaagttcaaaatacatcatccatgagtaaagtgacccagtagcattactttataaaagtcagtttttgttgcatttttttttggagacagagtcttgctccattgcccgggctggagtgcagtggcgtgatcttggcttaccgcaacctccgccgcctgagttcaagcgattctcctgcctcagcctcctgagtagctaggactacaggcgtgccacaccacgcctagctaatttttgtatttttagtagagatggggtttcaccatgttggccgggctggtctcaaactcctgacatcaggtgagccgcccacctcagcctcccaaagtgctgggattataggtgtgagccactgcgcccagcagctgcatttttatctaataacagatttgtgggatttttttttttttttaatttcaagatcccaaagaacatgtcatctgcaaataggacagttgtattttgcattaccctctaccatggcccctgatagtagtctacccatgctaagaagttcctacttacctccacttagactactgatttttaaccctccccagtcaccttcaggctcagccttggggtgccctggcccttcctgttatcactctggtgtgctctgggattgtcataacctcatattttcaggaaaatgaaaatgtgtataaaaaaattaggaaaataacctcctttgatatgaaagtttatccagaaaatcacacaggtcaatagagctaatatgtttaaagaccttcatacttccgggcacacagatctcagtaagacatagtctgttttcaaagccacaggtgcagagaagaaaaaaaacccaataaagctcaagttgttctcattcattaactacattcaggaaagaactcaaaacaacccaaataatttaagtaacttttgaacagtgtttgactatcctcaggctaatggccaaagaaagccagaaagaagagaaaaaccaaactgaaacccaagccaaacaaaacacaaaaatcccattttatcacactgagttttaggaaataggtttgttttcctgttgaggtatgggacagcaattcggaatcatacttatcacactgagttttaggaaataggtttgttttcctgttgaggtatgggacagcaattcggaaacatactttcagtgcattctaggattgcctatgtgttaaaggaggctatgtttctcattgccagagaaggacatgctggagtgaacagtgtggtgtcagattgaaattagaggtcattgtataagccaggtcttcccaactacttcagcattattgacatttgggtcagaaaattctcagttgtggaggctgtcctgtgtcttgtaggatatttagcagtatccctggtttttatcttttatgcacaagatgtgagcagcagtccccttcccagctgtgacagccaaaaacatctccagatagtgccaaatgtccctgggggcaaaactgccccctgtggagactcactagtgtaagcaaatgacatatatatatatatatatatacacacacacacacacacacacacatgcatgtatgtatatatgtgcctatgtatgtagtatttatatgtatataaatatatatgccatttgaccatatgcacatatatacatacatgcagacacatctctctctatacatatgtgtgtatatatatatacacatatatagatagatacatgcagacacatctccagatagatatctacatagagctctctatatatctataggtataaatatatatatacggagagagagatgtgtctgcatgtatgtatatacgtacatattcacatatttcctagatctgtctcttgagacttggcagcaatgacatgttagtagcaatgagcacctatagcacccaggagttgagttgtaacaccattcttgactaaaaagagcctgggcattttggaaaaatggtttcttccagggctggggctggggcaacatgaggtgagcctgtaacatgttatgtcagaaagtaagaaaagctcaaaaaatgatggggacatatcaaaatgacataggagtttgcttgaaggtgctccctgtcaccaaatctggggcagcaaattaaaaaaatttaagcagtacaatgaataataatttaataaaataagattacacagcccatactaaataaataaatgagagaaaaagagagctcttccttactcaatgaatggatctcaacaaatgaatgtagaatagtaatgattccatcattagaagatcacacaggctggtagtaattgattcaggcaacagtaattcaatggatgctaaaactagtgggtgaaagtgggtgagtaacagtatatttacatcttacaacttttggaaagacatcagcttgactgaggaacatgtgattgtcatctcgcctaagtgcttttactgaaagatcgagagaaagacgtctaaattatgatacagtccagagtcaaatgagcaagtataattatttttatcagcatcaatgcttggcaaaataaatacttgttaaaagaatgaataatatattcctgttaaatataatatatggctgttgtgtcaatatcaaaatcataaaggtgccatcatgacatatgagcagagtaactggctgcaattttcttaggctaaataaatttttatcgtatcagcagagaagttttgaatgttaggccttcagctatacatataatttagagttttgatgctgaaaacagaaacctatatctgctagtagagtaaagaagtcatgtttgaattattcctttatattcatagagtctttaaacatgaagtctcactatggtaaactgatggaaataccaacatgtgaatttattattaaggagtaaaagttgtacattttacattatgtcattaagcagcatgaattttttcccaatataatccataggttcccaaggagcatgaatgttttttaaaaatgtcgagtgatttagatttctgttggcttgtacatcaatagttcctccctattgcaacagtttttacaaagctgagatgatctgatatgcataccagtcatgttaaccaaaagaccttgaagacttacctgctggggaatttttgccccctaaatggctcaccccaccatttgtggtttctctatgctttatgtaatttagtagctcacattcctccgctcgccatccacacacactgctatttcttttctctgcttcttatggtattctgtctgcacttgtatctatctgcatttgtatccagagcagcatctaatgctcaagacatttgttgaactcatctgactacaacaacacacttgtagtttttcatatttaacctgctaggtatctggtttatggaacaaaacccattggctcttgagttgttgccatgttgatgctctcaagtcttttcctggaagagcatttgaacatagagacatatttctcacctcagtaattatgctgaaagttcattatgtgccttcaaaatatttctaaagatgcaagaaaggggattggaattaagtggtttaatttattgatggtttttagcacaagtgaagagagaagaaaatatactaataatttaatagtgatgatgataataagaatagctccgtcatatagagaccttattatgtgccaggcatggttccaagtgcttcaaatacattagtccatttaatcttgacaacaccttaaagtaggttcaatcaccccccaatttatagaggcagaaattgagccacagagaagtaaagtaacttattcaaagtaagaaagctggtaagtcatggaacctgggctaaacacaggtggtctggccccagagtacagatcctcatccactatgccgaattcatatgccttacgatttctatgcaaaattttcctttgtcgctgatatggtttggctctgtgtcccttcccaaatctcatgttgaactgtgatctcgagcgttagaggtaggacctggtgggaggtgattggcttatcgaggtggtttctaatgttttagcaccatccccaccagtgctgtctcgtgattgagttctcacgagatctgattgtttcaaaggaaccctttgctctgtcttcctcctgctctggccatgtgaagacatacctgcttcccctccgccttctactatcattgtaagtttcctgaggtctcccagccatggagaactgtgagccagctaaacctctttttctttataaattacacagtctcaggtaggtctttatatcaatgtgagaatagactaatacagtcacctttttctgtaatttcatttttagatagaagaaacttaagagtaaagtaaggttgtttgcctaatctaatcacactctaagccaagagctcacggtctaaagctatcaaggtgtagcacattatccccataaatttgcaaatgaatttgaaaggaaatgaattgacaaagcagattccacaattctgaccactccagaaacagagttaggtcactgtctctgtagcaaagagagaagccccaccatgggttttggttcaaaagtcaaagctatctttgtgattttctaagtgcaaacacagatgccaatacttggaagtgctcttctaaaccaccttttgtctgattataaccttcagcaggcaacaggaagccttactatgcgttactctggggccattgtgcagagtttgtgggtgtgtgtacagaaagggctctatagatttctctctgggggcagatgaagcccataaacatgttctattcctatgatatgtgcattttagcaggagaaacagtaatacaaccaaatttatttctcccagctgaactttaaattctatgctgtggattttggtcatctacccatgagcaaaactgctgttcgtctaaattttttctcaaaaaatagtgtgaggaacattctgtagataaatatttgtacatgctctatttcttttattaggatgaattccctagaaatggaatgactgcaccaaagtctatacaaacatttctgaagcttgcagtcttgtaccatgaactgccagatcactctgcagatacatggtgctagtttgcaaagcttacagtgtcaccaggcagtgtataagtaagtgtctgctgggctaataacaccaggtattatcttaaacagaacaaaaagcaaactttgccaattcaatgtgtggggaaatggtgttttattattttaatgcatacttttttatttctaatgaggataatattttatgtgctgtgtgggccataggaagttcttttgtgaactgtctgctgtgaacacattcttttcctatttttctattgacttatatgaaactcagttttcatgaaaacaaccctaagtacaagttgctgagtagttgccatgggtgtggtactgtgctatgctcactgctatcttcttcgtggcaaatattttcccaggtggtttgtgttttaaaataccctcttgtgaaatcatcactcctatttcttgagggagtttttggagcagtctgttttagaagtctacattagttcatttttagcatttaacatcttgagtgggggcctgtgtaggctgcccctgagattgtgcggatctgagcgtgtcctgcaataggaagggtgccgggtcccagcctgaaggtacatgtactcagtcgctaccctggacgccacggcctgtgactgtgctggggacctcagaattaggttccaggtgctccatgggcattgctctgtgcctgctcttctacggatcccaaagggacagaaccttgagggccgacatgctgagggacactgatgccactttccagtgacactaaaatatgggatcacagtggtccagagagctcttggacacttacccaagaacctcttgaaaactgcacaggattatgattgaggaaaaacagcaacgacccactagccctcaaaatatcgtgaggcagagacatttctcttgtggttttggaaactgtctaccctgttgccatggttacgcaaaagctggtttaaaatggctcctatgttggcatctgggctggggcctaactacccgtctccaccattttctctactgcctaccccttcctctcctccaggaagacggtaagctcccggcatggcttctgggtgtagtcactgtgccaagcttaaggctgggccagtcccacgaactgctcctgcctccaccggctcactctaccaagtctggacttgccacatatatgctgctgcctgggctcccttcagcttctcgccggcatctcactggctgtcattgcctttccttgcttggagaggtaagacttgagctttggcttgggaattggggttgaaataggcaaaagcagtctttccatctgctttggctctggcccattaggctggtggaagctggggaaggagctcttcactcagttctgccctgttcaccgggtctgtgcctggggatgaggaatcacctgcttcctctctgggactgcagcagaagggcagggggtggaaaatggtcagatggtggtttttaaatctggatatgctttggcatggattagggcatttgttaaatctagattcctgggccctgtttccctttgtctcaataggataaggtaggacatgagagtctacatttgtaattaattaattcattaattatgcacaaggtaattcaaatgcagctcgtctggcctttggaaagcagtgaatttggagtaggtcaagtaggtcacttgtcctggccaaaagcatctaaggacatattgctttcaacatcctccttcttgtaaacctgaatggccctttagcgccacctttgcacagagaattttttttaaatgtaaggtaattgtagtaatgattaataccagttaaagaagattactttttgcaagtgtggcctataaatatagcacccagtaaggaatttgggagttcacatttgacttccaaaaccaccttggccttgatggtgactcatctcctcatccagagattgcaaggttgatggatctacagtgctccagctttcacatcctctgctgtgcacccttggtttctcactctcttgttcctgctttcttacctgcacatctcccataatgagggctgctgtggcagacaccagacaccgacaggcctggtctcagaagtagaaaggttgcgtgagggtgtctaaaatatacttaagcatcctaataaggctgcttctaaagtcgcccacatggttaaatccaaagcatgtcaatatccatttgggaagggccctttttaaagggcccctgggcagatgaaggttgtcctggcagcttgaggttggtaggtgagtacacacatatagcccaggccaaagaattcatgacatcccacctcccacagattgcaggagtcaaaaagttcccttgagcaatttttccctctagacagccggccaataacatcaacaaaaagtgcctcatgtgcatcttctaagctcagtggcagatgggaacaacccccacaaggactgtgccagaatgaagctgtgatttcagcctctaagatggaacattgcagaaatacccttgcgggggagcctaggccctgcccaccagcagaagccaaatctacctcctgtgcttcccacgtggccaaagggggtgtggctgacaatggggagaaagtatgaaatgtgacaagggcagcaaggacagggctacatttggaggagtccggcctggtctctgtcaatctatctcatagataaaaaacatgaacaggatcagtgcaaaaacaatcactttcccagccctaaatactcattccatgtccatttgaccacttggtgctaggcactaactggccagaaacataaaacacttacttaaatcaattggtgcacaagtcattagaaaaaaaattcaagaaagaaaaagaatcagattcagcttagataatatgctcctagatgcagcatggaagccaggtaggaaaagctgggccatgcctgattcctactgaaggaccacccaaaggatagactggggactggactcggggaggtgacagaagttaggggttcagcttgctgtccaaacgagttccccacttagagcaacatgaaaatctctacagattccatggggaaacttttgaccttgggagttgcagttggttcaagatagtggatcactgggtgatgcattgcacttgggaattcatgcatttaatcaactaatattctatagacttaggacttctaacttcagaggctgtgctcttcctgagtcaccatcttggccctgttactaggagataaagctaaaataagaggggaattcagatggcttctgcctttctgtagcttatagtgcggtgggaaaatggatgtgaataaaatgatcagcaaatacatgcagtgggctgagaattgatcatcacggttcaggttgcagaaatggaatgttctctattttctcatatgtgaactccatttgttctcaagaccccatttctgctaaggggttcaaagggtctttttcataacctctttggtaatttcacagccaatttagaaatcaagtttgatggattcaaagcttattgattaatgaaaggactcttgtctcttcttgggaggtttcccctccattcttcctctctaggtttgcatctgagagcagaaaaataacacagcagctttctggctgtctattgttcctttcctgaaagcctagccctcctggtggttggccactggccttaatcacccttgcatccagtcccaccttggggagaaactaaagacatggtgtgaatgccccctttctcatactccgttagattttgtatctgtctgtggttcagacagaatgcagggatagaggaagaggttggctaaaaggagagagtctgatacaatgttttccagtagccataaaaaagttggtagattagtcaaaatgatagtgtttaaagagaccctatcttcctccacagtatccccagtctcctatagtcatactgtcaaagggcatcaatgaggtgccgagtctggggtcactcgaggtcattggaggccattaaacattaaatgatggatttgagcctctgccacactcagtaggcagcagccatgcaaggagggcagtctctctgggtaaatcttctaggtaagagtaattttatttagtgaatttgcctaatcactaaaaaatggaacagtatttactaaaaggatgtagtgacaaagtacagccttttcccttaaagccttcttcattcattttaattagtgaccacagccacgacactgtaaaagtagattgcagtgatgtgaatttccctaaaggttctagttctgaaaagaatgctttcaaggcctgtacatgttagacaagccaggcagctccctggaaaggagaaactctccagaggagacttgcaaagatgagttaattcaaactcataatcatcgaccgattcattcctccactcactcaacaaatgtttaaatatctaggggcatctgctatatgttggtatagatggattgatgcagggatgtatggagagagagagggaggcagggagataagaagagtggcagacagagagagagagagagaataatacgtattatagggaaggggtattctatgccttcaaaacacttacagaccttttggtgacataagagtatacatatacacacagtaaaacaatattttcagaattaagagtaatggcagacagcagtatcaaagatcacacacgctgtctatgtcatgatttagaaccaaacagaggccaagggaatggaaatgactgaccaacgaggcatagccagggctggtcctgggtaggccgtgaaggggagataatatgtgtatagacacaaagacagaaagtgttcatggagcagtgactacacaagtctggctggagtgagaggggtcttttcaaaagaagcacgaggcagtgtgatgaaggatcaaaagcacaggttttaggacaaagcagttctgaattcaaacccctgttccatttctcagtgctgtgtagcctggagcagtgacttagccttgttgtgcctcagattttttaaatctttggaactggaacaaaatcatccgcctaatgaagtttctgtaatgatggtagaaaagaatacatactggcctggcataggcaaatgccagttcccttacctcttgtacacaatgctttataacacataacacacttccatagatactagccatttggccttcaccataaccttgtgacatggataaagcaggtataaatatcctcattttatgggtgcttggagatttttactatacaccgctccttaggaaaatagagagaaagaaataaatggaaaaacactctacgattagctcaaacaaagacttgaagattaattaagtgttggaatttaattcaataggtaataggataccattgaatagtctacaccagaaaaatgaaaggttagcagtattttaggaagggtaatctggcagtggtaggcaaattggatggagaaggagttactcaagtatgcctctaaggcaagtattttgggtgttgctgctaatagaagtatcaagttactacgtctcaggatgggctgctgatgcaatttgacatcatttcctgatcaccaagaagacatgtgcagtggtccatctgctattcttgtttgcctcttcctcccttgcaaagtgatgataaagataatgacagtaatacaaatgacataatagctaggggtctatgtatcaacagtgcagtggaactgtgtttacatagtaaaactgaatcttcaaaatgttgaagatggggactgtcatgatcagagaagttgataaccggcctagggtaacagagctagtgttgagaatacaggtttgaaacgagctctcattcgaaagtctaagccttttccactctgccattttcccttcaggatttgggagactgtcttttatcacagcaaaggaaatattttatttatacaaactctgcaagagagtcaaacccccaatgttggcttccttaaggactttattgatggcaccaagaaaagacttaaccagcccacaatacagagtactctcttgaggggcattccagcctctgctggggtcacattgccatcttacagagtcttaacctgtgacaggggtacaggctgaacccccccagagacttatctgccacatcagcctcctactactctttctttgcaagcccaagtctgcacagacaataagagtatttctaagacacaatctcatactgatgtgaatctgctgaaagccatctgttttctctgggtcaagagtgagctctgaagcccagtgatcaaggccttcatcacctggcctgggcctctctcagctccactccttgctctacaatttgcccccaagtgacacataaaattcttctttgccccacagaccatgacatttccagttggtgctgagcctcttcctttcctgtacctttacattttcatttccccaattcctcctaataggggcagcatttgaaaaggatggcttcccccttgttccagaataggtgcttcttcccccaagtgcctccataattccatatgcatttagccattatttcccaacaacactgtattaaagtctccaggacatattcctgtctattagattgtgaataccttgagataaagttctattgattgattcatcacctttgcataatttctggccagtagtaaagatttaaatatgatgtttgaatgaataaatgagtgaaatgttctcaaaaagcattctagaaaggttcctccagtacctcaatatccacaaaatgattcacaatttggaggcatatatggggtaatgtggcaactgttagcttacccaagaacaaagaagcaggaatgatgaaccatcactgagaagctctaatcaggaggttgaaatccaaggagggtgggtggagggagggacacacacctgttctgtgtgggcattggaaactagtcaactctgacatgtaggccatgctccttggctcttatttaaaaccagtttgcagagaactaatggaggagcacgtggaaagtgtaatgcagggaaagaataagctctacatggaggctgaaacatgggcacgccctggagaggccagcttctgaaataatgtacgcaggaagggaggagattgctgtacacctcatgactcgatgtgtgctttcaagctactacattgcatttaatgcaattcctgcttgcataacatgataacaaacgtgtattagtctgttctcaggctgctaataaagacatacctgagaatgggtaatttgtaaaggagagatgtttaattgactcgcagttccactgtgattgtggggaggcctcacaatcatggcagaaggtgaatgagcagcaaagttacgtcttacaaggtggtaggcaagagagagcctgtgcaggggaactcccatttataaagccatcagatctcatgagacttgttcactaccatgagaacagtatgggggaacctgcccccatgattcaattatctccacgtgaccccgcccttgatacaggggaatcattacaattcaaggtgagatttgggtggggatacagccaaaccatatcaaaccagcacacttacagtttagctacccaacatgttcacctctctgagatgcagtgctaaatcagaagtaatcgaatttagcaatgataaatcggatatgaacaaagtagctgagtttatcacaaaatttatgtaataaagcttatgctgtttccttataggaagtcccatcagacacctactcagagccaatttatctttatttcacacgtgattctagaagggggtggacacatataatagcgattaagcgtgagggctttggagcagactgcgttcattccaatctggctatgatgtttgcaaggtgagtcactgtaagcgagctctttagaccctctgcaccccagtttcctcagctgtacagtggaaacatcaataggccatacttacagggctgtcattaggataaaagtactcagcaagtattagttattatgaaatgtggttatctagcatctaatctcacagtgaatttgaaacaacagtgaggaaaatggtgttagtaagtcaagtgtgctgaaaactaaggcaactgaagtttggcagcaacacaggcactagaagccgaaacatacacgttaaaaaagggcaatagtttggggctattggcccagtcattggaaaacattaaaaactccctgtccttttgaagctttcatctgactagggagctgaacatgaaacagaagaatgcatgggggttgcagctcagtggtagagatttgactgcagatgaacacataataccagatacaacaggaggtatgagggaaaataaagaagggcctggggagaagaagtgtaaggggatgagaaaaagcctctctgaggaggagacgttcaagctgagacttagatgtatgagagtgcgacgcatgtagaaatctgggaaagggcattcttggccgagggaagtgcaggtgcaaggtcgcgagcctctgttgtacttgatgggtttttagatcattagaatcctacttctatgagggagacttgtttgtctatttcattcactgctataccccaggtgcccaggagaatgtcagatagatggtatttgctcagttaatattcttgaataaatgaatgcaaggagacaggagtagctggagcattggaagcaaggagaagtgtggtgcaagaggaagttcacaagacagcagggtgcagaccacgtggggcccatgggccatggtggggacttcagagatgctctaagaataatgggaggtggctggaggcatgctggctgctgggtgggaatacacagtagtggacaagactggaaacaaagaaagcaggtggcagaataatccaggctggaggtgattgggcttgaactagaaaagggacagcgaaggtgatgacaagtgccccagttctatgtatacactatgttcatcactgcataacttgatagaggatgaaactggaggaggactagttcaccaacagtaagggaatagacagggaagaggtggcagaagtgtattattgaaaattgtgcagcaatgaacctaatagcaaacagaaacagggataaatattaaaaatgtgggccagtggcttaggtgggtggtggctcatgcctgcaatcccagcactttggccaaggtgggtggatcacttgaggtcaggagttcgagaccagcctggccaacatggtgaaatcctgtctctattaaaaatacgaaagttagccctgtgtggtggtgggcacctgtaaccccagctactcagaaggctgaggcacaaatcacttgaacctggaaggtggaggttgtagtgagctgagattgcaccactgcattccagcctgggtgacagagtgagattctgtctcaaaaaaaaaaaaaaaaaaaaaaaccaacaaaaaaacaccaaaaaaacaaacaaacaaaaaaccccccaaaaaccaaaaaacaaacaaacaaaaaaacaagtggcatagaatatacattttggaaaaatacctatgacaccattctgttcatgtaatttagaaatgaccattaaacctcatgtatcttagtatcttacagggatacatatctacatatctgcatatccaaagataaatttcatgctcttttgagttgatgtttagtggaggctgggagtggaggggtagtgaggagaggaatgtaaggagaaattgagataaaaggaataataataaaaaatatggtggtaatgtgccacatcaaggaatgcatttaaatcttggcttctgaggctcaaacacaaagaaaacaatccctttgaccccaaccattaatgaccaatttctctgtgaggacatgtaatttataaaatcattttacttttgtggtatgtgtggtccctagcttcctaaattgtcctcaacaatcactgcctcctactattcatgcacctgtttagttctttctcatgctgaatagggctgacctgcaaatcaatgggatattacagaaatgacaatgtgtgactgccaaggctgggtcataagagacattttggcttattccttattctcttggatcagttgctctgaaggaagccagcagccatgttgtaaggaaactcaagcagctctgtaaagacgtctacatggtgaggaactaaggcctcctgcaaacagctaccatgcaattgccagccacatgagtgcaccatcttggaaccaaatgctctagccccagtcaagtttacagatgagtcctgcccacatctttactgtaacctcatgagagactctaagctggagcacccaaataaactactcccgaaattcctgagtcacagaatccctgtggggtaacaagtgattattactgttttaagttgtcagtgtcgaggtaatttgttatgcaataatagattaaatggaccctatttaagtcagtgctctgtactctttccttcagaactacttcactaagagttgttgagaagtaaaaggactgtctggcttgggactgattcattgcttctcattacctcctctttcccttctattggaaaaagtgttaaaagccataatttaagtcaaaataagtaaccacctagttcaggtaaaatcaagtcgtataaaactggagcatataaaatcaaatgttggcactgcagataaccgtagaagcatccttaaacagacaaatgagtcctaggattccacagtggttttcattaatgcttccttttctatatcatgtagacctctgaaaaatcattgccttactttgaaaccttttctctttcctctctttacaaccttttaagagagatctataatagtacccatcaaaaactgatagcttaaatgagtgaaataattttgcatttcctcattgttagtaggacttaaaactttcccacagtgacagagagacagcatgtcctgagggattggcatatgaaagatcctgttggtctattgagcagctcggtgggagaagtgaacaccttagtccatcacagtaaagagagccacgaatataaaatgggaatggcgttttcctcccttgttggaaatgatgtctactagtttgccatactactttaaatgtacagtaaggaaaaaactgtcatgattaaattctagtaaatcagaaaaccaagaatgcaaatagaaccggtaactggaggtacaaacacttacctttgattgaattcagaatttgctggtgatctctgcctggccaatggtttgcacttgtcagacagggaacactgcagtagggtttggggctcacgatggaaacagaacccactgagacaaggaggggcctggctgcagttcaggctgcaggatgtgtgaccccttccaggtagccatgaggcctgaactgagatgttcacgagaatgttggaaacaggaaccaaggttgggcaaagttagaaggagtcttaacaactggctgataaatattaatagaataggccagaggttgattcccagaatctgtagaattccagaaaggacaaagaggaaaattataaaatcagaagcctggaggacccttgggattcagagagagaaatatcttctttatccaagataacagtcatcacctcattagcaataacagaacttaatattttttgtaatataaaaacatttttttctggaaaaggtacataacattatattgtaattataagtccttatttttgagacagggtcttgccttgtcactcagggtggagtgcaatggcatgatcacagttcactgcagcctccacctcccaggcgcatgtggtcctcccaactcagcctcccaagtagttgggactgcaggctcatgccagcatgcctggctaattttttaaattttttgtaaagacagggcctcactacattgcccaggctagtcttgaacatctgggctcaagcagatcctctcacctcagcctcccaaagaattataggtctttaatcatctgaggggaaatttgagatgatgatgaaaattagacaaagacaatcaccaggtctttcttaggagagagacaacatgtatagtgaagatcatgggttttggatttaggtagtggtcctgtttcatcccaactttgtgacctgaagtgagctaatgagcctcattttctagaagttagtatttatgaagagccttcactataagccaggcactgtgcctagggatttacatgcatgtttccagtatgttcccacaacagccctctgagtgttgctatcttccaatttatgaatgaggaaacaggctgaaagagaggttcaatcatgtgtctaagttgttgaaactaaaactgctggtgtcggaaggcaggcgtctgactgcacagtcggagctttccacctctgtattacaggacctccagcctcggaggggaaagcttcagaatacgttttccaggtcctggtgacagaggagatgatcttgggaaattgtattcagactagtaagtaagttctaggaaggatcaacaaagcgatggcatctgaatttgtgccaaccaaatttgtcttaggaagggctgcagtaacttggtctcccatccgtccaaatagaatggaaaaaactgaacaggataaagtgcatctgccccttcacagtgagccaagccagcctggagctggagttaagaccagaaacctttaatctgttctgggcttttgctttcctggagggcagaaattcattttgaacagtacctaacacttactaaacagtaaatgtttcttgaattgaaaaatgtttccaaaaattatttgttttgttcaaactatgaagatgcattttttttctgctatggatataccgtctagggtttgggtacgggagtaacgatttgggtagaattttggagctgggacaccaggtggggtggattcagcctgaggatgataatcagaaccagcaacatttttgtttttttttttccacctaagcaatctcttgatgcagctattaaaaataaataggtagtttcatcttcagctttctttacctttcactttcagagaaaattggttaccattttctttgtgctctccattcggttctctatttcacatgtcttttctggttatttagttccctggcatcaatctcctatcttcaacttcacctgctcttattgtcttccctttctgaatctgcacgcctctgtcattttccatggatcaaggaggttaaattgacaaataactgtttttgaaagaagaaagggaaaaaggaacaacaaacttcgcttggatgtttggaagtctgccttcacagatcgccaggctttgctgacttatttataaaagactatttttattttggtatcatcaaagagcttattcatgtcaaggtttttaaggtgataaactgcaaagatggaggattatctactgtgaaagagagggttttttttttttttttttctggcatgaggaaaagaacatcactgctaggaaatggtctgggcctaacaccagattactccttttatgaatttgcaaatcggtagaactggtcagtcattggaaaggggagataactcagagagtatcaagcatacctgagaaaaactggcatgaaaaagaaacccaaattaaaataaaacagcctataattcattttttctttctaaatgagaccatctatttgggtttgtgtcctttccaaattcctaagttgaattcctaacccccagtgtctcggaatgtgactgtactgtatttggagatagggcatttaaagaggcaattaggttcagatgaggtcctatgggtgggccctaatccaacatgactggcttccttagaagaagaggagattaggacacagacacacagggaggaccatgtgaggacagaggaaaaagacagccacctgcaagtcaagaagagaagtctcagaacaactcaaccctgtgaacgccttgatcttggacttccagccttcagaacataaggaaataaatttctgttgtttaagccactcagtatgtggtactttttaatggcagctctaagaaatgattccagtctctcgtgcacatttcatcacttctgtacccataggacgtgtgtgtgtctgtgtgtgtagtgacgagatgagattgaagaaaatgtctttatctttctagctcagtactcctcaaaatgaaagtaaaaaatagtgcaagggctggatgcgctggctcacgcctataatcccagcactttgggaagctgaggcgagtggatcatggagtcaggagttcaagaccagcctggccaagatggtgaaaccccatctctactaaaaatacaaaaattagctgggcatggtggtgcgtgcctgcaatcctagctactcaggaggctaaggcaggagaattgcttgaacagggacctgggaggtggaggttgcagtgagctgagagattgcaccactgcactccagcctgggctatagacagagactctgttaaaaaaaaaaagtgcaaggtgactgtggctactgctcccacagattatttctaacactgactctcagctgcctcagccaactttctgcttagagtatgagctggggctgaggccccataagactgacagataccgcttctaggaaccatgctcatccctgggtaagaattactgctgtaatcagcattgttactgtggaaagtatatttattccttttagaatgttgtgaaggtaagaagaagttgagaatcactactttgttgagagttccttgctgtacttctatcttgggcctttgaggtggatggaaggacatacctaaaaatggagaaactcaccaagccttccgcaaaaaaaacgatgagattggaacctagccatggtatccttggagaaaagtgtgaatgtggctcttttactaacataacagccaagtttggtttccttaaatacacaattgggtggccttttatattaactttgttttcttctcaaaaatctttatggtttcttacatctagggtaagaatctcagagaatctcagcatagccattgaaagccaggttctggggccagataagctgggtctgaatcccacatgctcttaactaacttctctgtgcttccaatttccctctctctaaaatgggaatgatgataatatttccatcatcaggttgatgtgaggatttaaagagttaacacatataaaatccttaggatagtgcctggtatgggagttcattaacattacttatcagaatatctccaactgtgcctaatagtttgctttaggaagaaaacaggaatccctaggcaaagtatgaaacatcttacaagatggaagcaagcttgaagcaacaagtaaacatcactctttgatcgttccatatttggtgttttgggagtatacaataaaacacttataaaatggttacatttggagtagaatgtagggcttagaagtatcattgagtggtacgattggttctaatagttatgtggagataaaatcaggttaaagtgaatgtcaaggtaaatcttcaaagggaaaaaagaaaggccaagaattctttaaaatatttgctcaatatcttttatgtaaaacaaagataacagcatcttcttatgggatttttaagagttaatatgctcccttgggagatatacctaatgctagatgatgagttagtgggtgcagcacaccagcatggcacatgtatacatatgtaactaacctgcacaatgtgcacatgtaccctaaaacttaaagtataataataaaagaaaaaaaagagttaatatgctctttaaagcaatggtttcaaataatggggtttcctttaaatataatgaaaatattaccatatagttatgggaatagatgccactgataattttagaccataattcagaatctgtcgatgaaaattattagataagccaagactggggataataccattggaacctcatgttctagaaattgattcttaaagcttgaattttaataatgcttaataagtggtttttgattttggtagaaagctatcataggtatacttaatatcaacatttgtctgattagagattttatgacataggtactttattcccttattttttttttttaccttgagtcctttggttgcacaaataactttaaaagaataaaaagtgatgaatatctaacatcaaatcctccttactcttcattgctgtctctaaggatggcagggcaactgggtggatttcctctgatccatgaatggtccagtctgacaatgtggtggacagacatgaagtatagggactgtagcttggttcatttgctcaccacgtgtcataataattattagaccaggtcagtccaggggctcaactaatgtgtcaatggtatggttttcataagcaacaaatatcaattaaaaggaaattagcatcttacctttcaagtcaaacattaagaagttaagtcattttccaaggcaaatcaaaatagatttgatcaattatttgtatgctttattacttggttcaattatttacactattatattagtgatgggggttttctgggaatttactaaatataaaacaatcagagaaacaaacaaaaacactctttaaagcaaagtattccctctgtgaaaaaaactatcaagtattaaaattaatttggtctctaactaatgaaaacctttctggaagagtcctatcattttctttgtggcaccaaggttattcataattaaaggttctgacttattgctaataaaagataccaaaaatgatctgagtcactgctaaaattcaccttgaattttgattgaaagaaaaaaactgataaattgcattcatctcatttcatttaaaccttgacgtgatgcttttagaacttactgctttaatttgaagatacatttgtaggattttccactaagttcttgatattttaggggggagacttacatgattattgggataaagctccttgttttattctttgaatgggtgttcaacagtaatgaaggcagctagagaggagagagacgtcttgactttcccaatgctccactccctgcaatccctaaacccaccgttttttcctaggctacacacaaccactgcattccagcctacacacattgggttgggtatagaccagtgttttttacaacctaagatctttttaggggattgttcctaccaagaaacagaaagaactctctttatgtgttcaaagcactgagccgatacttccaagttctttccgtttcttatctctttagttaccttaaccacaaactaggcttgtctgatcatggtgctgacactaggctgttctcagcccttgtctggcttatctcttccaaaatggtagatgtctacctctccctgtcccctcaatctctgcctctacatgctgttttgatacaatccatctttctcttgtttcacatagacactggtcttcattactctgcactctgggcatcaaccactcacttagtcccagttctcagtcagaccaactctgttctaaactaagatacacatacgtatgttaaaggaaatgctcagtgacttctgtaagacgttgaaaatactttacatgctttaccacactttgaggtttaaggggactccccccaccccaatttcactaccatttgtgagctcatttggtcacactccccctgcagaaaagaacttgccctatatcacatttccttactagctaatcttaccggttggagaatataatgttaaaatggaaagtgctactacaacaagccatgatctcagagatccttttatattaatagaagaatccaggagatcagggcctcaaaggcaaacaagttactacctgatttttgagtgagttaagatttgtaatacatcttgtctctgttccaaatagtggtggtgttggtgggtgcatctcaggaaatagaggtagttgtgggtgaaagaagtgaggaggagttgggcctgtagctcaaagcaaaaggtaattgaatgcacatccccaaaatggtaggctcaggaagcaaagtacactcccatacatccaatctgctggggcttcgttaggaacacagaagagaccaactgaagggagataaccaaggccaggcaagacccagctagtgctttggaaggcagaggctgaagatcttttccaggccaaagacatccagttgatggcaacctcatcaatttgccaagagcttgtcctgctcttgtcttgccaagagcttctcttgctgtgaatgatgccagagaaggtaggggccacagtgagtcaagcacactgccagttactcagctcactagatgctggatcccccttcctttttccactattgaaaattcatgcaaagtggcaggtttgtcacctgctgttagggtttcacagaattcttcctctgcatatgcctgtgacgatctccttcctactgcctgcctctctccagcactgcagataagtggatctagcgtgttgtcttgtacagggtaagagccaagcacgcatgcctaggttggtgaaagtctattaggaagaaacaacacattcagtaaggaatagttaaaaatgactttcagcataaaaaggaatgaatcaatggcatttgcagcaacctggatgggactgcagactattattctaagtgatgtaactcaggaatgctctcagtcataagtggaagctaggctatgaagcataagaatgatacaatggacttgggggactcaggggaaagggtgggaagggagtgaggaataaaagaagacaaattgggttcagtgtatactgctcgggtgatgggtgcaccaaaatctcacaaatcaccccaaagaacttactcatgtaaccaaataccacctgttccccaaaaacctgtggaaataaaaaattttaaaaaaataaataaaaatatggactaagaaaaactacatcattataaacctaaacagaaattatcaataattctttcataataaaaaaggaatatgtttcccataaaaaaggctttcaggaagaatattgttatgaagaaaagtttaagaaaaagaggcaccaataacacagggccctggaccttcatacatgatatcattcagcaatactttgctggctctgtgtcatacatctgtctcttggctctgatctctttcttgcccttaccaaagggctcactgcaaactgtatttcccagcctcccttacaattggcttgagttaggttcaaaaaattagatagtaacttgtttgtccttcagtgggaggcttggtgggagcaagagagaagtcagggtgtttcttctgctctgcctcaagtggctccatctctttgtagctccggacctggggcttcagtggtctcaggacccagctgtggctctgggttctgggtaccttttccctgtgacttcacaccacaggtctaggttgtgtaggcttcctgctgctaatctgttttctagcccttcccaccatcttggtaacaattccttctcttaaatcacgtgatgtgggttctgccttcctcacaggaccctggctgttatatccccattattttactataggaaatttcaccagcagagcgcctctttgtcgatgcaggacatcctctctgagttatgtctggactggttgtatatagttgacccaatataatgtgcaattgtatttaacatcacataagcaaaatatttgacacaaacacaagcttatattttgttctaaaaatctgttattttctaagaagatcatttataatatgggtgagatgttagtaatgattacaccaaatagcataaatcacactggaaaaatatatcttattgaagaccacctgtctacaccttttttagtccacatgatattttgtttctttaaggaacacaaattcatttatataaatcccaaaacacagatggtaggtgctaggaaaaacattagaatagatgcagccttttaacaatatctgagatttgaaggcacagtgagaagtgagttctatattactgagattttttcataccaactaaacatctccatgttcaagaacaatctgatctaggctctttgcctattggatttaccacttaaagaataatagcttgagtacccctaaaaatcccacaaaatgagttaattatgacagaaactccaaaaaaagaggcagagccagtatttcattatttgtggagagttgtgcaaccatctttgctggtttcaaagtaaggaatatgttcacacacatatacttcctgctggaatgatgttttctctcctacctggttaacacctctcatccttcaaatcttgagccagttagcacctcttcatggagtcaaatcccctctggaacaacagagtgtgccagtaccaggcctaacctcagaagcacatatcacactgaagtctgtacttctttgctagattattggattagcatctttctttcccatgacagagcaagcctcctgagggcaaggactgtttccaatgttgcttatgactattttccttgtgaatagcacatgctaaatactcagtgcaaaccagtcaaatgagtgaatgaatgaatgaatgaatgatgaacattcattgagaacagaacttctcaagcttcagaagtggtgatggcactggaaccagccctgatatctgctgggagtgctccacagcttttctgaacgctgcttccatttaccctagtctgaggcagactcacctggcaaagattatctgattttttaccagcccttagaagggactgttttttattgtgtattctaattgtagtgttacaataaaactgaaagagaattttgataggtcagcaatttaaagaaaaaatataggtattgatatgaatgaactatacgggctgacagttatctatggtcaaggaatgacaagactggaggagagtccaaacctgagagaacagatgagaaagtgtcccttaaacagcacatgaaggcaaatcatcattcagctcagaagttaccttttctgcacttcctatttaaaaagtcaatgttttggggtcagcagagcctagacaacaatggaagaaaactcatttagttcctacatgtttgccccatggtgtaagactaatgcaattgatctagagctgatttaagcattaacattctaaccagaacaaaattagcaagttaaaacgtgacagtggttttgcagtggttctgcattttcagtactaacctcacattacacacatatacaaacacatacatcaaaatacttctggggaaggaatcttctaatatatttaagttcatatcttctaattcttaaatggttgatgtgtaattatagtgtaaaggtgtctcttgatggataaatagaaaacttttggacaatagctgtcaaagtaatttgaaaatgatgtactggttcttcatttttccttttgtttgatttatttatttattgattggtccagctcttcagctgaatttaatttcaaatgtatccactaaatttttttgtaatttcaagaaactctggtttacagagaagaaaagttgagttggcctattatatggtttggctgtgtctttatctaaatctcatcttgaattgtaatctgaattgtaattcctacgtgttgggagagggacctggtgggaggtgattggaatatgggagcggttcccccatgctgttctccatgatagtgagcaagttcttaagagatctgatggttttataaggagctcttcccccttcacacatttttttctctcttgttgctttgtgaagagagtacctgcttccccttatgccatgatcgtaagtttcctgaggcttctccagccatgcagaactgtgagtcgattaaaccttttttgtttataaattacccagtctcgggtagtatctttatagcagtgtgaaaatggactaatacaacctattaactgagtatcagttttactgaagatttaggttattagaattattaagacattttatggaaaacacaggatggtagaaaaacgtagagaaatttctataatagagagatagttaggaatgttatattacattcttgctagtgattagtcggtttataagatggattctaaaactatgcgtaggagcatttgactgaagttaattaacatgactcagatcatacagtttggggaagaaaaaagcatttcccctcctgagggatgattttttactgcttttatcttttaatgccagatgggaaaatatcaaggaagttcgctttaatctccttagctctttattaggatgtgtcatataatggtactctggctcattgggaccaaccctatactcttggggggaggattcccactgaggacgaaggctgttttaacttcacactattgaccactccccctagtgatttgcattaaccaggtgcctgaatggagataacagggtggcatcggaccacggcaaagggttgatttcccacttgggtgaactggttgatcatggccacaaacctgtagcctcagccccacttagcctagtgttgctattgagccaaggggtgacacagaagagcatgctgagggtaggaacaaaaccatggtaagtggagagaaaagggtaaatgttaatcatttaactgaacatatactcattggtcaagcttcaatgagattatcttgcataaagaaagatgtctattgaatgaaataagtgtatgaaagatgttagagggtactgaacagttgtctttattgctacagaatcagaagcaatggaaaacaattataggcaggagagagtttacaataagtaaataagcacttggaatctctttcacccacccaggacggatggctacatgccaccttcttgatgtccagggccatttttcctcttaactactgaaggattcatctgcttcttttcctaagttcctaccagggctagactctgtgttctgcccttggaagactgaaagccatctctaagtttattagttgtatatcgaatatgcaaaacagaaagcagcctaaatttttcaaaagttaattgtcctgagaaattgctttacctcagatttttgagtaacttattctttagctcctgaaatggtgtgtcccagagttctgctctgtattttccaaagggaaaatatttttaaattcctataagtttagggggtataagcataggtttcttacatgcatatattgtatagtggtggagtctgggccttcagcatacccatcacccaaatagtgaccattgcatgcaataggtaattttcaacactcagtccccctcccaccctgccaccttttatagtctccagtgtttattatttcattcgatatgtgtatgtgtgccctttgtttagcactaatttgtaagtgagaacaagtggtatttaactttgtgtttctgagatatttcacttaggataatggcccccagctccatccatgttgctgtaaaagacatgatttcattcttttttatggctgagtagtattccatcatatatatgtacactacattttctttatccaataatctgttgatggacacttaggttgattccatatctttgctattgtgattagcgctgagataaacatataagtgcaagtatatttttgatataatgatttctttctctttggttatatacccagtagtttttggattgctgaattgaatggttgttctatttttagttctttgacaaatttccatagtgtttttaaatggaaatattttcaccattaaaatagtgatgcttaaaggatgatggtatggcatctgatatttcaatcagtctgaaacatactctaatcttttatggcatctctaaactagtaagatgggaaaaaatggccggagagattccatggcttggataaagttgttccatctgaggccttgtgcttggagctctttatcatcatcaccatcggattgtcctgaggaagggaaatcacttctaacattactgttataaggaatatttcatcacttgcttttaatattaggtaaatattgatatttgggttttctcttaatatataaaagttatagacaattgtttatcattcaaagtaagaaggtatttttattttaataaaggaaatggtcaaatgtggaaaagataaagacttcaagaattaagagatcaagtatttttttaaagttatcttcctaaaaacatattatcttaaaaatatttctcatttcataataaattagaactatgttcatgggattccacttgagggacaaaaataaaaggccccacagggatttcagaagctctgatactaagctgccaaaacaggatttttgatgttaagtggtgtgaacagatcttattttaattgacacatttgaagacgagtaataggatgtgtgaaggatgaaactgaatgtacttcaatgaacattaaacaatatttttactagtaagtaaaataataaaactatttcacacaagaaggtgtcagtcacacttaattattttttaagcaaaaagttatgtgacttatctctccagtgccacagcattgtgttcaaataaagggaaagtctcagaattatctataagaaacaagtgaaggagccttttcagatgatgataaatacaagattaggaacttttcaaagggtctataaatcactaaagggatgagatacttcttcctaagacagtgttacgaggggcagatttacctcacgcctgaaacaaccaaaaacaccagacaaaacatatgatataactgtttgcaaaacactggacatgcggacaatgaagggacagtgatcactgacagatgggaaacaaataagataagcccccaaattgcccctgcttacttcataaagttgcagcgcgcagactctctgaatttagaagacagggaggagagtgcaaggagataaaggcagctggaattctcaggacagagcaccaaagagaagagagctgcctggggatccgcagaggatccaaccggcaaatgcatgtgaagaaattactccaggctgcgggggggaaggaacatcagaaaagattagagaacagtgcttggtgtccttgcagagataggaagagtgcctattcctaccaggctgcctggaaaaactcagagtttatggggcaatgggtagtgtgctcaaagacctcttgttttagtaagtggggaattactagccttatattgggcatgctccggacttgtctaacaaatcataaaagcaagacccaaaaagatcaagctctttccaagggacttaactgtatcagaacaaaacataagaatatttataggaatacaaaaatatccagtacctgacaaggtaaaattcacaatgtctgcccatcaatcaaaaagttaggtagagacaggccgggcgccgtggctcatgcctgtaatcccagcactttgggaggccgaggcgggtagatcacctgaggtcaggagttcgaggctagcctgaccaacatggagaaaccccgcctctactaaaaatacaaaaaaatcagccggatgtggtggtgcatgcctgtaataccagctactcgggaggctgaggcaggagaatcacttgaacccaggaggtagaggttgtggtgagccgagatcgtgccattgcactccaccctgggcaaaaagagtgaaactccgtctcaaaaaaaaaaaaaagttaggtagagacatgaaagatataaaagacacccaattgaacatctagagagaaaactagtatgtgtgcaataataaatacactaggtaacattaatgctagattagacatggcagaagaaaagattagtgaacctgaagacatagaaacagaaactttccaaaataaaacacatagaaaaaagaacaattcctcaaaaatgaacaaaaatacattggtgagctgtgagataatgttaagcagactaatatatgtatacaactgaagtttctgaaagggacataagaagaaataatggttgaaatttgatgaaaactatatatctaccaatctaagaagctcagtgaactccaaacatgtgaaatatgaggaaaattgcacaaaggcacatcacaatcaaactgtataaaggcagcgataaagataaaaatcttaaaggcagccagggaaagaaggtgttcttcatagaggaacacattaaaatggtggtagattgctcacaggagcaatgaaagtgagaagatccgtttttaaatctggaaatctataccgaagaaaatgtctgttaaaaatgaagatgaaaggaagatgtttcaccctgaaagaatccctttaacatttttttttcctttttttttgagacggagtctcgctctgtcgcccaggctggagtgcagtggcgtgatctggctcactgcaagctccgcctcccgggttcacgccattctcctgcctcagcctccccagtagctgggactacagtcacccgccaccatgcccagctaactttttgtatttttagtagagatgggttttcgccgtgttagccaggatggtctcaatctcctgacctcgtgatccacccgccttggcctcccaaagtgctgggattatagaagtgaaccaccacgcccggcctatttttccttttcttttagacagggtctcgctctgtcacccaggctggatggagtgcagtgatgcaatctcagctcactgccacctcagcctcctgggctcaagtgatccttctacctcagcctcctgaatagctgggactataggtgcacacaaccacacctggctaatttttgtatttttttgtagagatggggtcttactatgttgcccaggcttgtctcaaactcctgggctcaagtagtccacttgcctcagcctcccaaagtgccgggattacaggcatgagccaccacactctgccaacatttcttatttactcatctcttttccaggatttgaaactgcaatagacaaaataatggtcccccaagacattcatgttctaatccccaggacctgtgaatatttactttacatggcaacagggactttgcagaggggattaagttaatctcgagatgtggagattatcctggacgatccatgtgggccaatgtaattatcagagttcttataagagaaagagaagaacaagagagtcagagccagagactgatttgaagatgctttgctgctgagtttggagatggaagaaggagccaggagccaaggaatgctggtggcccctggaagcctgtaagggaaaaggcaagggaaaagccctcccctagagcctgtaaaggaacacagccctgtggacaccttaactgacagcccagtgaaacctcttttgaatttctgacctctggaactgtggaatgacaaacttatgttgttttaagccactaagcttgtggtaatttgttatagcagcactaggaaattaatacacttacattcaggggatgacacgttctaactgactgattaaccacatagattttacatgtatcttagatatttttaaaatcgttagacatttgttaatatccacactactaatccctttctatttactataaattaatcttgaaaaaaaattacattttctgcttcaagattattttattactttattatttacttactaaataatttaaaatcattgatgattaaaagctattgtcattgtagcaaatcactcaaattcatagttgatagaaattgaaggaatttctatcttagtcattcatctctcttgcatattaaattatatggagcccagtatgggaatcctaaagtgtgtatttgataaaggtaccttgttcagtggagtcatttttacattcttccctattccatacttttttttttttttttgagatggagtttcactcttgttgcccaggctggagtgcaatggtgtgatctcggctcactgcaacctctgcctcccaggttcaagaaattctcatgcctcagcctcctgaatagctgggattacaggtgtccactaccatgcccagctaatctttgtatttttagtagagacagggtttcactatgttggccaggctggtctcgaactcctgacctcaggtggttcgaagtgggcagatctgcccgcctcggcctctcaaagtgctgggattacaggcataagccatcactctgggccttattacatacttttaaaaacagcaactataatatggaagcaggggttatgtatgcctgtaatcccaaagtgctgggattacaggtgtgagccagtgcacttggccttagtccatacttttaaaaacaactacaataaggaagttatgtatgcatgataaggaggtagaagaagcaggactttggggacagtctcatatgacagctgggacttcaatactattgtgaagagagattgcaaattaggataagcaaaaaaaaaaaaaaaaaaagaggacagtatgaacaagaagtcttctggctaagtcaagtactcaagattggccaagaaaacaaatgaaagattcattaaaggcaatgaagagagttcacagtttgagaaacagaaggccttagagagtttaatcctctttacaaaaaaaaaaaaaaaaaggctttgtggcaggttttctggtatttgagaatctggagttataaacaggatgcttcctgcagcattattcctcttacctggactgcctccaggcattgggaggaacttctcactgacagcttctcaggagctgatgagtagccagtagttaaagccccaggtgagcatcgtcctcccgtttgactttagtctgtggtgccagatttttcccaagcaagtcctgtgctttgacatttgatgcatttctgaagtggactgcctgtaatatctcaaggaaggcttctagttatcttattcttagacctcgaaccttcccctttcaagcatgaaaccaaaaaagcaaagtgtgatgttgggtcactttgctgcttctacccaccaaaagtttgtgtccaacctagttgaaagatttctttcaagcacagatgaaatttcagcaccacattatattctcattcaatgaacacagctcttcttgtcagtattaaattagtagccagtaggctaacttctacatccttataatcgcctcagttttttttttgaaagaggcagaaatatttctgctcaatattttaagactcaattttagcgagaggaatctttaaagagctgtacctgaccttgtctttaggtccttttgtttacctgaaacgtctacactctcttttgcacagtttttcttcaaacctattagactttcttgtggtttagaccagagctcttaatcagaaacacaattggggccgggcgtggtggcgcatgtctgtaatcccagcactttggaaggccgaggtgggcagatcacttgaggtcaggagtccgagaccagcctgaccaacatgatgaaaccatatctcccctaaaaatacaaaaagtagccggacgtggtgtcgcgtgtctgtgatcccagctgcttgggaggctgaggcagaatcgcttgaacccgggaggtggaggttgcggggagctgagttcataccactgcactccagcctgggtgacagagcgagactctgtctcaaaaaaaaagaaagaaagaaagaaagaaagaagcacaatgggagtcacaagcataactgcaaattttccagtagttacactgaagaaagaaaaaagaaaaaaagtggtgaaattaatgttactaatatattttatgtaacccgatgcatctaaatgtattattatttcaacatgtaatcaatatacaattattaatgggttattttacaccgtctctttttacactaaggcttggaatgaagtgtgccttttacacttacatcacatttcaattcagacaagcttcttttcaagagctcaacagctgcacatgaccagtagataatacattggaaagtgaggtctagcgtctctcccttcacagacctcaggaaaatcctcccctgagtattatctccagtatctttaactttccactggattctttttctctgccttgaaacatgcacagcactcccttgaaaactcttcacttgaattgtaaccactttacgtttcatttctcaatttcctatccctgatcagctctttaaataaaacacaaggctttttcattgcatttgctgttgctgactccttgctgcttccccaccttaggtgccttttcctattgtctgctaggtctcttcttgtgtctcctttgctgattcattgcactctgacccctaagagaaggaggtcggggaagccagcggttcccacactttatagagtgcctctcctggagggcttcttacaacttaaattgctttagccaggcatggtggcctgtacctatagtcccagctaatgggggttggggaagagggggttgatgggggaagcccaggagtttgaggctgcggctatgattgtgccactgcactccagcctgggtgacagagcggagacccccatctctaaaaaaataataacataaagaaacaaaaacttgaaacctaaattgctgtgccgtacctccagagtttctgattctagacatccggggtgaaggcgaagaatttgcatttctagtgagttcccaggtgaagccgaggctgttagtctggggaccacactttgagaaccactgtgaggttcagtcctcggcgcctctagccttgctccctgcaggtgcctgctccccagccaggccccctcttgcagttgtgggaagctcgattctgtgcagtgtccaggtggcctgggccttggagttgactggccctcatggtgtcacggctgaccttgtattagtgaatcctggtacatgggaaatgaacttcttctggccagtgattggttctgacaaatgagacctggggttagggggagtccaggaggttttcttactctggaaaagagacacgaggctggcttgttctcttcctgcttctggacactgtggcctgggggcatcacccagaactacgagtcgccctgggccgctgggggagcaggccacagaggccaagccgcacactaacctcagacacagagagggaagacagaagggctccggagccctgaggagttcactgagcaaggaagggagcatcctgaggcctctctcctgcggtatgagtgacagtgggtacacacctcctttgggccatttgtagctaggttttctggtacttactgcaggaaacctccaacacttcaaaagctcccaccttttcctcctccaattgctatgtctggttggcttttttctgaagcctttttgcaatcccacttctttctgtactgaattctctccctcctccccgtctttcttgctctgtcaaagatgagagcaggccagtccctgacattttcaggacttaggacgggaatacaaatgaaaggtcctggccctctgccccacccatttctcttcccacacctggatccacaccataccatgagcaggatacacaagggcaccagcgagtgtgtccaggttttgtccatcactccctcctcccagcaaaacctcactccttggccatccttcatccaaggagggcacacactgatgcctggtcagcagtgggagggcagacctggagaacagctttgcaggccttggaaggggcctcagggccaactgactgggaattctaccatcccaggtacctggagcatggcccacaagtggggcaaggggaagcatgggcttgggggcctgcagactcatcatgctgctgtgaggggcatggacagaggaaagccacagaggggtcttctgacacagggcacaggacagtggcttgggttgctcaggtttcagggaggactggatgcaggatgctaacatgattgaccaggttcttggactctgagtcacatacagtaaaggatcccttcgccgtgtattaacaggtcatgggcaacactttgatctttctttggtacaagacagtagaagatattaccttaggatattgattctcaaaaagatctgggaatttttgcttgagattaaaaaaatatatatgatgcacaatcaggcagttacgtctcagtggtaagaatttttgtttgctaccacttttaatatctgcagtccttcttttttggattcatttgctgaaataaattccctagttattctttcagaaaggacgtcatcgggtaaactttgtccaatcactcatcgtttcttcacattaaatttgagtttgaactggtaacaaactagtattcattttccctgagcacttgggagaattgatccaatgactgctggtgtgtagaatgaattgcgatgaaacatctcatcctacctgctcctcattcccttgtaagtaatctgtgttcacttctccctgcagcctggaacctttatatattcatatatttatttatatgtaaatattctgaacatttaccaagctgtgtacttcagggaaattttcttttaatttggtcagtattttccctcttccattttttgttcttttcttctgaaattcctatttgatagacgtttgaggtttggctctatccatcattcctacatcactcttcccattctttccatccctatgcttgttttcatgatatttttaggaatccttccaggacatttattctttagttgtatgcattttgctttggactgacagcgtgtatctcccaggagttttaaaaagagtggcttggtcttattttattgaatatttgaggacaaaatgattacatttctttggttattatgcttatctgaaaattgtctttgcttttttttctgttgacaaggtctccttggggtgagttagttcttcagtttgttgatttgatgcttcttgtaggtgttggtgttctttcaaagtttggtgattctcagttatctattcatgctcatgttgaaggactggttgaagactgaaaatttcctcaatccaaatgagaagtgctgttttctattcatgtgcatcttgatctcttctgtctgccttctataattgtggggagagcaggatgggggagactgctttgctttgggggtgccagaggggatttttccttaactggaacatagccttcttggcctctcttgttacagtcctcacttcagaatacccacttggaggcttcacctgaagctgggccagttccagctccaaaggctccatttcattgcccccctcaccccccagggttctactctgcttctcataaatataaaccagcagaagagcttttcctttgttgagagcacagttgctgggccttgtgaggctgaaggaaagtgtgcagctgcctggactcaaatgtgcatgaggatgaggtgcccaggctaccctgctcttccaagaccacctcctaattactgacacatttgccccaggtccctttcttgtacagtttgtctctgagcttctctcctgggctgtggtttgtttttatcctttacctttgaagctccattctcttctgtgtactttgggctgttttttttttttttttttttagtgcaattttatacttaattggattacatttgccttctggttctctgcttcatattttcagtgtgattatggattgattctttgtttccattgcaagtaccttgatatatgcccttgtccctcaccaaggctgtaggtgtatcttctatgggatctctagtgtaagccccttcagctcacgtccaacacctaggctatctgctgtgacagccactggccacatgtgaccattgagccctagatttcgaagactttgtacaaagaaaaaggaaggtaaagcccttaagaataatgtaaataccaattaaagtttgaaattttaatattttggatgcattggcttaaacatagcattaaagttcatttcatttctttctttttatttctataatgttgctactggaaaatttaaaatcgtatacgtggcttgggttatatttctattgttctacactgcaggaggcgtcattcctaagataaaattaggaggagtgggttaagatgatgagctggatatgtatacacactccctatttattctcaaatctcagcataaaacacaaaagtgtaagataatttacactctttaaaaaaggggcagtgcagacaggaagaacaccagaggtaaatttctttggcagaatttatgtgatttagggatctatttatcattagtggaaaggcagaaaaaggcccaggaaaaaattcaatgtttccaccttgggaaaatgggccaatagttgtcctgttaatgatgtgaactgggaagctgtagaaggagaaaagagtctgcgtgaatacggcagaggtggtgagaagacaacgagtttggttttgcatttgcagtgtttgagatgttcctggactgtccacatgttcaataaatagatgacagagtgagcaatgctgggaaaagggcataaggctggagatacgagatgggaatcttcgctaggagttgtcgctgcagtggatgaaatccccaggagcaccgctactgaagagtgggctgatgaggaagagccttgaaggaaaagggggtatcagcaagaagaaccttgataaacttctatacacgaaggcctaacatagcaatgatacatggtagccacttagtgtttcaggagttactagaataccaggtgtgctttaaccagcgaagcatgttatcaatcaagggtttttaagaggtggcacaaaaacaggagaaggagaaagtgcaaactgtggacaaagagagtttgccctgggaacaagggagtctcactttggttttgattgggatgaacaaatcttgctcttactcttgcatgcttataaaagattctactaagagacttagccacagtaggaaatgtcaccaaatttacgtgaactccaatttaaaaaagaatacaaagacatttcaaatcctaaccacctggccagagggtgattcctgttgtttttaaggctatagtgatagaatttcaaaggtgaaaagatctctttgtaaacaaagagatctttgtaaacaaatagaggcatggattcactttatttcttttctgtggcctacatttgtaacacaaaacactgaacaacaccacaaagcctagaatcactgtcaaaatgtcaatatgggcacttggactaattcttaagttaaagtgaaggatattctggaggacctgaatgaaagacttgactgagtttctaatgttttgcaaaaaataagtagccagacaaggttgacttaaaaccataatctatggtggtggatccaaaataaatcttaagaacaacataaagacaaaggcttagcagctcaagccatctgtttttggaaattttggcttttgggatttaagaacagatttaaatgtatgaatttgtcactgattggaacaacccattatctagatactggagtaggttgtgatcaaatcataacataatacctaaagaggcatcaatatagtgttgtagaaagaacaatagatttaaagttcctccactcaacaaacatgcttgtgtgtgtgtctactaccctgcaagtactgttctaaataatagagtacaggccaggcacggtgactcacatctgtaatcccagcattttgggaggccgaggtgggctgattacctgaggtcaggagttcgagacaagcctggctaacatggcgaaaccccatctctactaaaaatacaaaaattatccaggcgtgatggcatgcacctgtaatcccagctactcaggaggctgaggcaggagaattgcttgaacccgggaggcggaggttgccgtgagccgagatcctaccactgcactgggcgaccgggtaagactccatgtcaaaaaaaaaaaaaaaaaatagagtacagctattaagaagacaaaatctctgcctgcctgcttggagttaacaatgtagttgtcagatacagacaaatacttaagtaaacaaccatatgaataattttaaataataagtgccctgaaaaaaataaaaatgggacacagaatgatagggtggtagaaaccacattcgctaatgcggttggaggggagcactacagggaacagcagctagaaagggtgaaagctcagaggctggagaagcttgttatgttcaagaaggagaaagggggccagggtggctggagtttcacagggcttggtgggtggggaagtagtaggagatgaggatggagaagtagtgctctatttgccttaagaagtttggatttggttctatttgttggggggaaggctttagcaggttttaaccacggaactgttatgatctaattcaccctaccacaaaatcactccagctgctcagtggagaatgaaccattggaggtaagagtgggaactgaggaatgaattatgaagctattgccatggattaggggatgagaaaatctctggttgcagaagatgagatactaaaaaaaatcggactagaaactgtttgggagccaaaactgatcaaaggggttttggaaagatagcacaaaaaagaaatccaagacaatgcttaagtttttggcttaagcaactgatatatggggatgatatctactgaggcaggaaagacgggacagaagtaggcttgaggtaagtgaggattttgttttggacctgttacattggagatgtttattagatattcaagtggagaggccgagttggcagctggattaacgagtatgaggtgagaggggacgtctgagctagagataacagatttggatgacatcagcatgttgatgttatctgaaaccttgggactaaatgagatcatctaggaatagaggagaaggtcatcaggaaaagagctgcttggggcattcaatgttctgaggtccaagagaggaggaggaggaggagaaagccaggttttctaagagaagtggccagtgaagcagaagggaaaccaggaggtgaggtagtccagaacctggagaagagagtagtttaaaaaggaaggactagtccactggctcaaactgctgagtgactaatcttattttaatatgtctgtgtaaatatggcagtgcctgtctacattggtggagggaatgtgcctaccacattgtagagggcattccataaatactaacttatctttcttcctcaaaacagtcgctgggctccagccaggcactgccaggcactgtggtaggcactgagcgaatcagcaaggaatgagaaatagattatgaactgatgagctcacagtgactttaacctttgcagatatttgtcctggcattgcagagttttatttagaacagtgattctcaagatgtggtactgcgatcaacagactctgcagaacctgggaactcattaaaaatgcaaattctagggcttcaccccagacctactgaatcccagactctggggttgaggcccaggaacctgagttttaacaatccctgcaggtgactgatgccggctgaaatttgagaaccactggtaaggaggagagcaggctgtcctctgcagagctgtcatttaagctccatttaaacattatagtctctaaagagaaagtgtaaaacagatgtaatggtagtattgatcactctctgtttcatttctgaagcccatacttggttattttgtcttaaagagcatttgactctacttttggcttcagactatgtggagctatttttaaaaattcgagtttatgtatttccacaactaagtataactgttaagggcttctgagaaaatcacccaactatgcagattgatccccacacacacatataggataaatgtgtgcctctcagctgcactggacacctaacaccgagaggcaagccatacttcccttcttaggactccttcacattctccttgtggctgttttgaacatttcatttgtccatttgcttatcactaccaataaatcatcttactgcttactcttcacagataaaataagttattggaaaaacttcctgacactaatccagaatatgtaactagctctatcacatctttctgcttttgatcatgtttagatgaaggagacataactgctctaatctgagcataaatttactgggacctcaccctgccccacttctttctcctgtatcttaaatccttcactgacccttagtatctttcctttaatatttaaatatgctaagatactctttcatcttaaaaggcaacgctagatcttaccccaatttcacatcatttttacgcagctattgatctccactttttattttatgcagtaaaatttctagcacttgtctatcttgttccctttctatccctattaatcagtgtgtcattagctcatggcaggcactcaactaagacctgctgaataaaatggctaactatacaccttaaaaaaaacttgaaaacacagaaagttactgaaaaacatattttgtgcaatctctttacccaaacagaccatcacggaagttttaaatagttaacatctttatatttgtattcctggctttcaaaagacagatcacagtttgatgaagttttagagagaacacagtaatatttggaggctgatttcaaaccaatattcaattatttgtgcaaatattatttagaacaagtggaggtaattgaaattcaaagaaaatgcctttcctgaaaactgtgaatcatcatacccaatcaaacttttattggaacagctaataagtaataccatgcaagggaggtttatttttttcttccttgtccctgcccagctatgtggaactaataatcaaaataattagcaacaagaagagaaatataattaagaggacctggtaacaaacaaaactattgatttcttttgaagaaaaatgacacggcattctttctccaactttcttttaaaagacattttgcaggtggcaagagaccagcgagacaacaaaggaaagaagttaactaatgaatgaacagcactggggacataggatgtatattctgaaagagaaatactattttccttaacaatattcaaagaaaattatgattattttgctactatgaaagagtttacaaggaaaaatttgaagattgaagtagttcaactttccaggtcaaactatgcgaacttccatctgccaaattttacagcaattctattaaaaacaatatactagaaatctcactaatgatcatgtagtcaatcaacacaccaataattgtcatctgaaaagaaatacaacttttagtcattccttcttgaagactaagtggcagagaaaaacagtgaggtctcctacggttaccactggtttttgcaaaacgttctgtcacattttactcaattaggcgttgactgagtgtattacaccgctgacccattctagccgtaggaaaagaatattaaagagaaaagggtgcttgttctcgaaacaaaatagatatacacagaaagacagtggtttaagaccttatttgtaaaagagatccagaaaaaagtagaagtacctgtccttgcagaaaaactgtggcccaagttatagcagtttcacgatttcggtctattcttaaaaaaaatcctaccaaagaaattagcacagatgcagctcttcagtattttattttagtagtgactatccacagattatgcaaaatcaaaattaggcccttaataagagtgccagcttccttctgccaactattctatgtctgtcagcttgcagttaaggaggctctagccagcgatgatccttatataattttttaatgtgtttcacgtaaagggcctttcttgaatagaatatgtaaaggaaaagactctaggattaaatacttctgataaagggccttcttaagactatcagtcctgtctgtgtctgtgtgttaagatggaaagcacacgaacagaagtcagcagatttgttgtgttacgatgtgggtgtttaatcagtgcttaatactagtggtaagtttgattaatgtttgtctttgtaggtaaagcaacagaacacagttttccagagcaacatgaagcaaacgtattacaaaaatgaaaatgcaaaatttaagatgagttgactaccattgtactcctgcaatttcccttgtcatcattctcttctttcatataaaaatatgattttattgaattttattttggctaaataatcagagttttagttttaaatctcatagagaataaatgagatgaattctttgcatattttcaaacctcggagttccatgacaatatgacaactagaaacaaaggaaaagaaaataaaacaatttcatcccagtattcttattgaagccattaggatcaattttgtagcactaataataaaaagctctccaaagaaagagagctttggtaatgaacctttgtactttaactcaaatacactgtcaaaagcgattttacaacaaatgtgagtgctacaaattacagcaaatatataatagaaatgtgtgggacatgagagagaaatgttggcctcatcaagaagtacatcttctagaaaatctaaaaaataaagagaaacaaagaagataaacatcttgccccatattagactgcaaaatagtaatacagtttcactcttagtttttaatcaattaattctcaaacaggtactaaatttagaatgaaggatatgttattactaaatcatattagagatatcttgacattaatattaacattaaaaatctggaagcaaaagggtttcttccccctaattgaactgaaatccactttaatatcaactgggattcaagaataaaatataagcccctgccctagttctgaggtccccataggagccctgcatcctgggcctatgaggtctgcttccacccttgtctctgggctaggtatgcatttatttccagaagtgggaaatgctggaatagagatttaaggcctaatcaagcattgagacagctggaaccaccttccagtttcacatctgtccccctctagcaccccacatctattccaggttattgcaaccaaagaacagctccctctgcctgccttctttcggtagctacagcacaacctcaaggtcgcttttctccacccagctttcagtctgtagcattgacctagagaatgaaccagactctggcctctggcaagaactttgcagtaaattgttgaccagtttgtgatggtagtttctattatttcttttcagaggtaggagttcttttcatgctaactgctttccattagtttagaattaagtcctctaaatcagtggcttaacattttttttgactgctaccgatggtaacaaattttacatcctaaccagtatatatacagggaaatacatacataagacatttataaaatgtatgctaacatatatatgacataatatcacatatgtgtgcatgtatacctgaaacatgttttgtaaataagtccaatgtattttgcctattctattcttttgttttttctaaaaaagtattggtatgtgtaattgactggtatgatgcacccccaagtgtttgcagactgcattttatattgttccaagacttaacttttaagactcttttgtccatctatcctttggtaagctaagctgtactaaggataacatagagaaatatcagtgtatccaaaaagaattcctggctgatggttttgaagagtcacagggcaataggtttagaaaatcttgttctctaaatagcaataaaacttaaacctggcaaattcttaagtatctttcattaagcaatccatggagttttattttaataagcataataattttcatgacagccttagtgaatattgagggacaagaaaaactcaaaaccagggttttatgcaactgtaaagtgctggtccagttgagtaagggaggatcctgtgaattaactaagggaagactctttacttgggttctcatcaggagaccatgaatagctttggtcatttaacggtgtccaactaacaagataacaatcctgtaatgtgtaaggtttcagttttcaaggatataactaaagaagtgttttcaattaaaatattacagtttaccttgtttttaaattttttatgagtttataaactatataatacctcttataaaaaatacaacacctcaaggcctatataaaaaaaaattatatcactaggccgggcatggtggctcatgcctgttatcccagcatttctggaggccaaggttggaggatcacttgaagcccggagttcgagaccagcctgggcaacatggcaaaattccgtctctatttaaaaataattttaaaaaattatatctatctatatcagtttatatataactctccctagtcctctggttgattcattctgtcttttctgtcttcagttatttatattcaaacatgtttccttggtgtgtttgaggcagttgagtcacacacacacacactctctctctctctctttctttctttctcatagttttagaattatacagtgtttgggatatagataagtagatctgtgggaacctgattattaagtgactagattcagtccctggcatccgatagtcctaactaatctattttttaagaagcaactattgagcaccactgtccacgtaggaactttgttatgttgagctctcagctttcctgagactcctgtgacaccatcacagcaacatgacacctcagggagggaggtttgggcaaatcacactagctccccctgccctggccagcaacactgagaggcagatgggcggggaggtgcctatccctagcctgaagccaaaagactttcttttctgttccccaatctgtgtttagagacccaaagaataagcccatagggcagaggacttttattctaaaagaggctctattctacattaattaggcttcagactccaaaaggataacaagcgtgagctcaagtaagcaaagcctttttgctgcagggtgttgtgtctaatagctaatttaaaaatatcaacaaatcactgtccaaagaaacttaattctgggactattaaggtattatcatctgcttgtttttattcaagttgagtaatccaatctttattgaatacttacaatgtacaaaataatttcctagattctataaggaacacagaaactaagatggtcctaccttcaggctgctgctatctaattagaaaaaaaccattttcagtaaaagagaatagtcagaatagccatagccaaaaaaaaaaaaaaaaaaagtcaatacatttgcttttaatcaggttgtaagatttatctggagccaatgacaaataataagctactagtcatttccgtcctggaagctgcaattcatctcagtttgtatgagctccgtcacctttgtgctcctgttactcctggtttgggactcaatttcacttcaggaggggagtggtggagtatatggttcctgcttaggctttaggagccagggacttccctatttcacctgtggttcctgtgtgagcatcccctagggaacatgctggaaggattctaactcgactacatttcttctgccagtgttgttggcaggccaactgagagtcttttccaaattgcctgccaatttttttccctcaattttagataattttattctttctgaaacctgacaaactaaatctaggctagaaagttccggggaaggcccagggctcgggatccatgttaaccagctgagggttcacaaggaaaacacaggagaagataatactgtagagtcatgcacagttgaacaatgaggatatgttctgagaacatgtgctgctgttgtccttgtgtgaatgcagagtggacttagatggacctagacggcatagcctaccacactctcaggctatatgctagagcccatcgctcctaggctacagatctgcacagcacgtgactgtcctgaatactgtaggcaattgtaacaccgtgggaagtatttgtgtatctaacctatctaaacatagaaaaggcacagtaaagacactttttattttttttttttttgagaaggagtctcactccctcgccaggctggagtgcagtggcgcaatctcggctcactgcaacctccgcctcctgggttcaagtgagtcccctgcctcagcctcccgagtagctgggatcacaggtgcccaccacgacacctggctaatttttttgtattttagtagagactgggtttcaccatgttggccaggatagtctcaatctcctgatctcgaaaacacattattataatcttatgggaccaccgtcctacaggcaattcatccgtgacctaaatgtagttgtattgcatgtgtgactgtattaagatcttttaattcagggcttttaaatattttcaaaagaacttttaacttcctaagggaagcttcagatttcaatagttcttcacacaaaaagatctcactttctgaggagagaaaaagtccagcttttccatgaatatatcatgggtttgcttcactctcagcatggccactgtttgcttttcttctttactggactaattgccctggtgttcctgctttggttaaaagtgaaacataaagaacttattattaatcaggtaaatgggagtatgacattgaaaacattcaatgtcaaaagacctaacataaaaaggaggttttaggtgattgaaacagggaagaggacagtataagactcacaccgatgagtagtattttacaatttataaataaaaaatataaaagcaatacatagcatggaatattattcagtcttacataggtaggaaatcctgtcatatagtacaacatggataaaccttgaggacataaaaaaaaaataaaaataaaaattaatcagtctcaaaaaggcaaatcctgtatgattctacttatatgaggtaactaaagtagtcaaattcgtagacacagaaagtggaatggtgattgccaggggctgggcaaggggaaataaatggggagttgttatttaatgggtacagagtttcagttttgcaagatgaagatttctggagatctgttgcaccacaatgtgaaggtacttaacactattgaactgtacactcaaagaaagtaaggatggttacttttatgtgttttttaattacaattaaaaataaaaattatatatataaatacatatgcaaaacaaacacttcatacaactcactaacaaaacaaacatccccatcaaaaatgggcaaggaaattgaatggacctttctccaaacaggatatgcaagtggcccatcaatacatgaaaagatgttcaacatcactaatcattagggcaacgcaaatcaaaaccacagtgagataccgcttcacacctgttaggatggttattattgaaagaaacagaaagtgagtgttggcaaagatgtggagaaattggaacccttgaacgcactcactgtggaaaatggcttggtggttgttaaaaaaattaaacacagaattaccgtatgatccagcaatcccactatgggtatatactgcaaaaaatagaaactagggactcaaacagatattggtacacccatgctcatggcagcattatttacagtagccaaaaagtgaagcaacccaagtgccctaagaagaatgaatggatacaaaatgtgatgtacatatagaatagaatattatttagccttaaaaagccaggaaattctgacacatcctacgacatggatgaacctcaaagacattgtgcaaagtgaaataagccagtcacaaaaacacaaatattgtataatttaatttacatgaggtacctagagaaatcaaattcatagagtcagaaagtagaatagtggttaccatggcctgggggagagggaatgggaagtcagtgtttaaggggtgcagagtttccacttgggaagacgaacaggttctggagatggatggtggtgacggttgtacaacaatgtgaaatacttaatgccactaaactgtacacttaaaaagtggttaaggccgagggcagtggctcatgcctgtaatcccagcactttgagaggctgaggtggttggatcacctaaggtcgggagtttgagaccagcctgaccaacatggagaaacccgtctctactaaaaatacaataataataataataataataataataacgataattagccaggtgtggtggtgcatgcctgtaatcccagctctttgggaggctgaggaaggagaatcgcttgaacccgggaggcagaggttgcactgcactccagcctgggcaacaagagcaaaactctgtctcaaaaaaaagtggttaaaagggtgaattttatgttatacatattaccataataacaaatgcattaaggaaaatatagagaatagaaaaaatgaaataaacatcacccataattctcagcaccctagcttaccactgctatgttttcttctggtgttctctgttccctgcatatttttatatagtattaattttcttcatgttactgggcagtctttgtaatttttaaatctatacctatgtcaagagaaaattactctgttcatttctttttgatttggaaaataatttgaggttaaattatttgtacttataactttgtatttatgactttttacattattttcttaggagaatgtcctgtaatgaaatcatggagttaaaggcatgaatctatttttagcatttaatatacaagacaaattgattttcaaaaactctgtattaaattataacgttatcagcaagttataaaggtactattctcatcatgccctcatcaaagattaggtcatatcattttttaaatctgttaatttaatagaaaaaatatatctcatgatttagatttgcatttctcttagattacaggtaaggttaaattgttaacaggtttcaatacgattctttagtagctatacaatctctttaaaaaattgtcttgacagaatttctgctgatttgttaatagctttgattgattcttctcattttatttatttatttttattcatttttaagacagagtctcactctgtcgcccaggctagagtgcagtggtgccatctcggctcactgcaacctctgcctcccaggctcaagcaattctgcctcaggctcccaagtagctgggaccacaggcatgtgccaccactcccagctaatttttgtatttttagtagagacggggttttcccatgttgcccaggctggtatcgaactcctgagctccagtgatctgcctgccttggcctctcaaagtgctgggattacaggtgtgagtcactttgcccggccttattatttttaaactgtactaaaatgctgaaatgtcagttaatgaattatgtttattctgtgttttttttttttttttttttgctgagtacaggggactttattgatgtacacaatgaggtagggctcccctaggtctcaccctcttcagggggtctgcatggaaactgtgaggaggggagagtctcagtgttgtggaggactgagtgcggcagggactccccctctctcttcctcttgtgctctcgctggggctggtgtccagctagctgctgcctttggaggccatgtggaccataaggtctactaccctgttgctgtagccaaattcattctcataccaggaaataagcttgacaaagtggttgttgagggcaatgcccaccccagctttgaaggtggaagagtgggtgatgctgttaaagtcagaggcgacaacctggtgctcagtgtagcccaggatgccctcaagggtcccctctgatgcctgcttcaccaccttcctgatgtcatcatatctggcaggtcaggtccatgaccaacacgttggtggtggagacaaggaaggccatgccagtaagctttctattcagctccaggatgactttgcctacagccttggtagcaccagtagatgcagggatgatgttctggagagccccgtggctgtcatgccagtttcttggaggggccatccacagttttctgggtggcagtaatggcgtggaccatggccatgagtccttccacgattccaaagttgtcatggatgaccttggctggtggggggcaaagcccttggtggcacaggaggcgttgccgatgatcttgaggctgttttcatacttctcatcgttcatgcccatcagcagagggggcagaggtgatgacccttttggtaccccctgcaagtgagcctcagccttctccatggtcatgaagacaccagtggactccacaacgtactcagtgccagcatcatctcatttaattttcgtgggatctcgccttggatgatgagtgatgcagtttccattgatgacaagcttcccattctcagtcttgacagtgctgtggaattagccatgggtggaatcatactgggacatgcagaccatgtcgttgaggtcaatgaacgggtaaccgatggtgacaatatccactttaccagagtgaaaagcagttccggtgaccaggtgcccaacacgaccaagttcgtttactctggccttcaccttcaccatggtgtctcagggacatggctggttctgcataagaatatgtagctgtctgtcaaatgggaggagcagagagcctgattcttacttttatggtttcttctattgttccaaagctcttcccactctagaactttcgaaggcgattcaattttccccctagtttttttatgggttgacgttgcacacttaacttcttccacttggaatttactatgttgtataggacagatcttgatggacagaggcagaggagggggaacagtattagtgaggttttagaggaagaattaaatgaagagtacgtggaaagtgtacgtaggtaaatccacctctctggtgaaatgaccacattgagtaataaagacatacctatctgtccatcaacagataaatgaataaataaaatgtggtatatataaacaatggaacactacaaagccataaaaagaagaaaatgctgtcatttgcacaacatggatgaacttggatgacattatgctaaatgaaataagccacgcacagaaaaaccactatggtcatgcaccacataataatgtttcggtcaaccacagactgcattgcatgtacagtggcagtcccataagactatagagccctatttttaccattttttttctatgtttagatgcacaaatatttaccgtggtgttacacctgcctacagtcttcagcacagtaccatgtgtacaggtttgcagcctagtagcaatgtgctataccatatagtctagttgtggggtaggctgtaccatctagggttgcactctataatgttcactcagtgttttcgcctaatgatgcatttctcagaatgtactcccatgattgacacatgactgtactgtattaactcacgtggatttttgaaaagcgtatctcttagaaagaaaaagtagaaatttggttatctgaggtgaggctagagaggagacgaagagatagggaaagaaaagatgttggtaaaagtgtacaaagtttcagttggactattacactgcaactgttatcctgcatggtaaccacagttaagcataatgtttatttcaatattgctaaaatacatttttaatgttcttaccacaaaaaatgataaattgggagatgacaggtatgttaattagcttgactgaatccttctatgatgtatacatagatcaaaacatcacactgtaccccacaaatacacacaattattatttgtcaattaaaagtaaaaatatagctgggcgcggtggctcacgcctgtaatcccagcactttgggaagccgaggcaggtggatcacttgaggtcaggagttcgagaccagcctggccaacatggtgaaactccatctctactaaaaatacaaaaattagccaggcgtggtggcaggcacctgtaatcccagctacttgggaggttgagacaggagaattgcttttacgtgggaggtggttgttacagtaagccaagatagtgccattgcgctccagcctgagtgacaaagcgagacttcatctcaaaaaataaataaataaataaacaaaaaaagtaaaaagtaaaaaacaaaaaagataatgggagatagagatggtgaggaaggagaagaggagaggctgcaggggtctgatctcaggcatcgcggcctatctggaggcagaacctacggcctcaagtgagtcttggctgggtggaggcggcaggacctgggaggagcagcccagttccaaactggagcatagaggaagacggctctgccacaggagagacaccagactttgcagctgcacttgatgagcaggagcagaaagtgcttacggcattataataatttgtgtccaaaatgaagtgggatattcatctttacccatagtaattttgttcaatgtgatttaaatgtgtttgcaaaaggaagggcatctcctaattcctagctgaataccagagctttgcttagatgtacaggtgtttctgccacatagctttcctactcctttccggaaaggaaaaaaaccaaaacgctcagcaattttcactgcactgttctctctctagggtcccgatagtttgtccatatgcttattactgaccatttttgcaggtcgctttttacaaatttatttattttttgaattgaaaaataaatattgtatatatttgtggtatacaacatgatgttttgaaacatgcatacacgtatcatatattcatatacatatatcaagctaattaacatatctattaccttatagatttgccatttatttgcggtgagaatacttaaaattctactcttgtagcaattttcaagtatacaatgcatctttattaactatagtcaccatcttgttcaatagatctcttggacttatgccctaaggtcactttttaaagacaagatctagttctttttcatatagattctcatttttaaagaatgcatggttagcaaatacattggaaagagtggaacttcaaaatgcgagagaatttaaaaagtaggattgtttgtctccaaagacctgtattttcatacgggcagaatgccggatatttgcccccatcagacgaaagggtattttattgatgagaacactcagttttcctctgcacttgctccactgtcaccttttgtgatttgattcaaagctagcaaggaaaaggacacacttcagcacaactcagcacagggagaagtgactaaagatttgtgtgcccacacgtgaagtaggagtatcttctgatgctgcactcttgaggcttccgtcctcatcccgacccatgaggattcagacctggcggagaccacagctcctgctagggccatacatgtaggaggcagggctgtgaggtgagggagttaaaaggttgcaaaaagatttaaggatcttagagggagggaaggaagagcagagtttctggggaatgttctctgcccaaggcaaagggatggcaggtgatgccccagaaggctctataactaagaacagggcactggggacaatcaagagaaagagtagactaggtgagaaaaactctcactaaatctccaatgcccttcagattctgcatggcttgggacaaaatgcttgagattgaaataaaggactgattgactattttcagggtgtcccaggatggcctgaactggataatagagaatttatggtatactgtaccatctatatgtatatgaaatatagtgatggattctctttcacaggaatttcctcaatcatcctaatctagtgattcttccctcctctgatctcctacaacacatacttttcattgctaatgtcttatgacaactcttctgtagttatcttgactactttttatattatattattggttactatttaactttcttttcctgatgggtaaaagtaaaatgcattttctaataaaaaataatgcacagagagcatatctggtcagaaataataggaagaagaaaaaaagaggctcttggggcagataaaataaaataaaagatcttcatggaatggaaacacttctgaaacttctccagtttgtagtcttttgaaagaaaaaaatcagaaaatcctaaggcaaagcatacaggatcttaaccatttttcactgtgattttcaccttgcttttcaggatgcaggttttgttgtcattaaaatgtttatctctaaaagtcacactgtctccacgtcatgtacatatctcagctacttcggcacacttatacatggacgtgtgccttcttcagatcacctttgactcaatacacacacttgtgctccatgacacggaagtgacaagatacaatgtgaatgattaactttgcaattaatattttctatattattttctataatatagaaaatgcatttgcttttggagcaggacagacagacttgtgatttggtgctggtaattaacttctctgaacatcaatgggggtacctctcagagacgtggtgaggtttccatgggatagcctgtgatcagttcttattatctacatgcctgacacatggtaagcccttaagacattcattccatttatagcccttcttctcctcatcattaagtcttttctctccagctggtttggaagctcagtgatggcaagaagcccattttgtactggttggtatattctacaacattctagcaccgtgagtcgcagacttaggtaattaataattacttacaaatttgaattgagaatgtgatggaatggtggaaaatcaaaacatgaaccatcattgcttagatatcttatgaaatttgttttgaatttttttcttaagtgtcattttctataattactaaaaccttcatatgatgattaaagagtaaagtggtttcactattgcttgtatctgaggaattataataacatatcaggaacaaaggttcccaaaaaacttgcttatagaaaatattagatgcatacttattagagggttcttttgggtggttcttcagagtcaaaggaatatagaaaatatttattttttagatttatttttccttatttgaaatttcaaagcaaaattatatgcacattttttcttattcattaatttagtatttgtaagaatgtaagggttatccatcaggaaaaagaaaaaggtaccttgaattaataatgataattatagtgattgccattacttaattatgccaggtacttatataatctcaaaacagtgctataaggacaaatttatttgtatgttctaacaggaccctaaattcaacattccccaaataaagctcatttgcctgatgtactcactatgtgtcagtatctgcttttaacagaggaagcagctgaacctccaaggatctgtggcttgccagctcacactagttgttgggggtgccaagaatctattttccatgaagtaatgtacaaaatgagccatctcaagtaccaccgctacttgagacatcattaggttaaaaaaatgctttatgttctctatcaaaactgaatgcaagattaaacctgtaaaagaacaaactgaacaaagaatgattaataccataatgtaagattatggcattcctcataccccaccctccttccaagaacaaacaaatctaaattacccccgtttaaaaaagactctcctattatgaaagaagcacttgtaaaacttgccagaatgggaaaataaatcatcagcccattctaacgtctaccgcattgtttaaagagataacagaatcagcaggaccattgcagctaggcaagttcttagacaacacccctataatgactgagttaccactgaaatgctccccgggaacatgaaactgcaacttgtggtagaggtttctttcccaacaaaaaacaggcacagagagcctatctggtcagaaataatgggaagaagaaaaaaagaggctcttggggacagataaaagaaaataaaagatcctcacggaatggaaaagcttctgaaacttctccaatttgcagtcttttgaaagagaaaaaaataatcagaaaatcctaagacaaagcacacaggatcttaatcatttttcttaatctgcctacaccttgatctcggacttcagcctccagaactgtcaggacatcaatttctgttgtttcagctgccagtttgtggtcccttctcatggtgacctaagaaaaccaaaatcccttgtgagggcaggtcccttcagtggtctcccctgactcaggatggcttcagtctctacaatgtctcagaggtcatatcacctcaattaccccaagtctgccctgtgctagatcattcaaatggaaatcccaagtctgcactgactaagtctcagttgcacatttttggctgccttgagactgcttcacttgtctgttctgacagcactctaagctccaggtgtctaaaataattcctcctctgatgagactgatgtactcctctcacattcaccctgtcacccaggctggcgactctaaagccatctttaatgttctttcccaatgcttctcacagccaagcagtcatcccctttccttgccattccttcattttcacttctttggcattttctctgcctcgaccttggttgaggcctatttatgttaggccagtccacaatcaactcctaattgaatcccctgcccctagtcctaccttgttgcatgcatgtctcaccagcccaggttcatctttcccctgttaatccatctcggtgtttgggtctttattttgcccacagagctcagccggttctgaaggccctggcatatttgattcctgaccaatcttcaccattgtcccctgcctgtgtcctccattcagacaggtttattgacccatcccaaccatgccttgtattcactcagtgaggagctatgtcttatttccaccctcattgtttttgttaaagccattgtcccttcttggaaatcacttgcatttatctaatcctaacccattctttaaaggtaatttcacatctcatgactgtgtgaacccttattcaaagataccagccacatgcatctgcctccttgagttcctctaacatatcctgatcccctttctaccttgattagcaagaacctctgagccacatgtgatccccagtgtcatactgtctccctctcttcctgatgtgatttatgttattgctttcagtttcattttaaagtctttttgtaaaacatactttttcaacaagaggactcaaatgctccaggcctggctcatactaagctctgaaaaaatattggctattaagttacaagcaaataaaaagttaagctaattacagctcatggcactcctgtggttgtcaattttgaatctcacttttcattattagctatattttttgggcagatgatataactttctgatcagactttacttcttaaagcctgggccttcgacttactttttttttttttttaacatagaacaaaataaatactctataagtgttctctgttcaatgaagagatatatacttcctaggaagactaacatatgttttaatagatgcattgataaacctgaaggacgggcttactgttcagtagtgctttgttcataaatgtagaaacatctgctttggggttatagggaaacttctttcttttaaatttgtacaggcttgaaaaatagttgtgctctataaataccccagtatgagtcatttgcttaactaaacagctgcttactcattagccaaatgcacttcattttaaggcatacacttaaatgaattttctcccatgcctctctccctcccccaagagccagaaaagtgatgtgcaaatacttttctggaatacaaaagagatacagatctgcctttgacatggggaatctaaactccatgatgtagcggaaagtcatcctagcgcaaattcataagctgtctgtatatgctttgcttgttcttataacaacacagtccttcattttctattcccatctctccccacacacctctggaacatcctccctcttcccattcaaatccaacataccaattctcccactggggcacccggcagggctttgttcttttttttccttctgtcaccatcgcccgtttcttatgcaggtggatagtctgcgtcaagactgctggtagaagccatttattttaataagtgtaagcaaatgacaagtattcttacaaatccttttgttaagatggaaacacagatcaacttctacaattagtggcattcagctatcattttctatccttcaacttattttgaacgataaatacaaagcaaccactcgcatctttttaaaattttattttgatttaacttttttttttttttaaagatggggtcttgccatgttgctcaggctggtctcgaacttctggcctcaagcaatcttctagcctcagtcttccaaatatgtgggattccaagtgtgtactaccatgctcggcttcatgcttttattttctttaaaaatggtcaatatcaccatgagttccttcttttggaagccagtaaatgtctaaatgttttggaagagtccagaggagaactttgatttctagaaagaccaaatgagaaggaacagatacagtctccagagttccaattatagtgtagctattctcagcaggattccaatccaacgtggatttttttctagcctgcggaggacatcttcaaacgcccagggctgacatttagctgttacccatctggtatgattgtaccttgttaaaatcacttttataccagttggtaattacctattgtcctgagctccccggatactggacccttcaatggtgacaccctgcctcccacaaaaatgtcctatgatttagcaactgaaaagttaatgctcgacacaggacgaggctctgactacgcagagccattttgattggacactggtttaataacttgactatcaccctgcaaatagcgctcgtttccaggtatgttaggtattaattattttctggaaaacaatctgactgtgctagctttgagaatgagagcatttacctccctaggtttatttacctccctagggtttattttcctcatctgtcaaatggtagagtgccttggcttagtgttcagactgggttccaaagttgcctcaaggggagattgctaatagatagaaatctggccccacttcctgcagagcagctcctcttccaggcctactcactgaggtccccatttcctcgattgtttggagaaaggattttgaaaactgaattttgctaccaaaaaaaagtttggaaaacaaaaaacccactggcttcaatgggcactaatctttcgtcctatttaaaaattctaaaattcaattataactgtgattaacaaaaagaatggcatctgtctaccaaaagcaaatagctacattgggtctactcggtaccaggcatcgttccaagtgctttgcgtattcgaactcacttcacccacagaactatgcctatattataattatttttagttattaaagtctaaaaagtgtatgttcagagatatttattttcacttttataattttcttagatacatttgaggttataatttattcaaagctaacattcctacaatgactatttaatgaaatgtaatcatgatattgtctttcttatatgctccaattacagatttctatgcatattttaaagagcgttttgtctttaacttttggatttcatcttgaaatcattagactaagagtatgtgctatactttataaattatacattagactatgtatgtactttctctgtggcttataccagtggtgcccaacctttttggcaccagggactggtttcatggaagacaatttttctatggaccagggcgggggatggtttcgggatgattcaagcccattacatttattgtgcactttatttctattattacattgtaatatgtagtggaataattgtacaactcaccataaggtagaatcaatgggagccctgagtttgttttcctgcaactagatggtcccatctgggggtgatgggagacagtgatataagtgttgcttatgtccacttcactctataatctcattttggttgctgtcactgcaatctcaggatattccgccttgactttaacccagaacctatggggatttgaagttctctcaaacatacatttcaggacactagatgcagctatacaattgaagtacctcaactcacttgccactataaagcctaccaccagaggcagcttaattgtcacttgccgctcactgataggattttgatgtgcgtctgtaagcgattgacttattatggtctctgcacagttaaacctctctgctaatgttaatctgtatttgcagccactccccagtgattgcatcactgcctcagctccaccttggatcatcaggcattagattctcataaggagcgggcaacctagatcccttgcatgcacagttcacaatagggttggcgctcccatgataatttaatgctgctgctgatctgacaggaagtggagctcaggcagtgatgcaaatgatggggagcggctgcaaatagagatgaagcttccactcacctgcgatgcagcccggttcctaacaggccacggacccgtactgcaggatgtctgaaagatgcactgtgtactgtaccagtaccagtctgtggcctgggggctggggacccctagcttataatgtttgtttcttcactttcaaccaaacctggaaatcagtttctaatgccagtccgcggctgtggcgctgggtagctgtaaatgtgctcagacatttcctgagctccagctcctgactgccgtggcttaactgggataaacagctgaatgcaaatctgagcatgaattcctcgtcactgtccttttccagaacatgaggttatggcaggcatcacaggcccggctgctccctcctgcctccactgctgcacttccgaggcaatgggttgctcgggacttttgcttctccctcccaggacccggtccctatgctcctggagggaagggagttgctggccatggttacccagttccctggagcagcctagcttgcgtccttgctggtggacggcactgtcttttcttagtgagtccagcagagttgggaaatggaaactatatcatgtgagaaagtaaagctgcatgggatgagaaggagaaggttctgagggttcctgtgttttaataaagtggcaaagcacaggagagagggattccactaattcctgtagcctttacgggcaggaacagagctggtaagtggcaggctcaggaggctgtgtgtcaatgaagagaaggaagacttcctgtccactgaggtgtccacactgaggctgtatccacacagccattgtatgataactcgtcagggatgacaaatgaatccaaacaggatgtgtagcttgaacagatgagctttattcagcattaaccatccatccaagacttcaactagtttgtgttaatgatcccccaaacaaatgttaacttgtcagtcttgatttgaagttaaaaaacaaaggaccaaactaaagagcttctgcacagcaaaagaaaccaccatcagagtgaacaggcaacctacagaatgggagaaaattttttaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaacagttagaatggcgatcattaaaaagtcaggaaacaacaggtgctggagaggatgtggagaaataggaacacttttacactgttggtgggactgtaaactagttcaaccattgtggaagtcggtgtggtgattcctcagggatctagaactagaaataccatttgacccagccatcccattactgggtatatacccaaaggattataaatcatgctgctataaagacacatgcacgtgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgcagggacatggatgaagctggaaaccatcattctcagaaaactatcacaaggacaaaaaaaccaaacaccacatgttctcactcataggtgggaatcgaacaatgagaacacatggacacaggaaggggaacatcacactctggggactgttgtggggtgggggaggggggagggatagcattaggagatatacctaatgctaaatgacgagttaatgggtgcaacacaccaacatggcacatgtatacatatgtaacaaacctgcacgttgtgcacatgtaccctaaaacttaaaatataataataataataataataataataataataataaaaagaaattactacttgttgagttttggttgagtattaaaagaagaataaccagaaatatatgtgctattaaatactcctcctttctcacattatatatgtatgtaaagccagatttgccttctacagtttgaccaagacaacatagtacatgcaacagagtgaataaagaggcagatataggaatttagctgccttctattaaaccagttattagttataaaaatgtaaaataaaaccactcacttttttttggcaaaatggttattttttttctaaaatgtatgttatttatgtgaagatttaatggagttattagttttcctttccaacttttattttaggttcaaggggtacatgagcaggtttgttacatgagtaaattgtgtgtcacaggggtttggtgtatagataattttgtcacccaggtaatcagcataaaactttataggtaatttttcaaatttttttaaaatttgttttaatttctaataaagtaaatattaatataaaaaaacaaaaaacaaaagacctcatttcctgtatctctaaagcacaagcccattctgagattttatagttttttactgatgtcttgctcagactttttcagtaaatattgaaatgattagaattaaatagaattcttatatatttgtatttactcatctctctgtatttccggtggggggatagagttcaaggaaaagtttaagagacatggttggttcatttcaggagtccaaaccttatgctaatgaggaagctttgtcaggggaatttcagatattggccagtggcagtggtgggaaccttggggttagcatccttgaaataacaccgcagaggtggtgagtggccagtgtgcctggatgacccagatttgagtggggtctcttctggaggctgactgcccaagcagcctgaagaatcacagagatactttctggttggtattgcccttctcccttctccccagagctatgcctgatttgggctgagacagtggaaaatacacaatgcatgtttcagacattcctgctttaatatgttaatatctcacccactctccagaccaggaatctcatatcttgtcctactcttttccacacaaaaagaaaactgcattacatatagaatttttcagtgtagctgttgcttatcccattgtaactaaccactttgatttatttttttgtgtatatcttgccttgacacgctttctttatcgaagaccacggaaacatggattctttgtgatattttgaaaaatgacaaattgaagagatttttatctctggagactcagcttttacatcataaagtacttctctcccctgatggctaacccaatcacatagttccacaataaacaagatgaatctagattcataagacagtatgtgcagaaaaatgctgttactctttgtggcttctttccctgtgccttgaaaatgttcattaaaaatctcctacttagtttgcctcattatattggtttactcatattggtcccctattttaatgatttaaagcacgtttgaaaagatttcttgtttggaacatccttggccaggccactactttgtaaagtagggaagtctgcaggccctagttgttcttttgaacttagttcataaaatgatttttaaacactgatctatcagcttttctcttctctttatcaaaattaataattcacataaaagccacctatttaaatggagtctcagctgggtacggtggtttacgcctgtaatcccaacactttgggaggctgaggcgggtggaatgcttgagtccaggagttccagaccagcctgagcaacatggtgaaatctgttttctacaaaaattacaaaaattagccaggtgtggtggtgcacaactgtggtctcagctaactgggaggctaaggcgggaggatcacttgagcctgagaggcagaggctgcagtgagccgtgattatgccactgtactccagcctggtgacagagccagaccctgtctctaaataaataaataaataaatggagttccattgttagcaacttacacaacctggaaaaatcaactgatctataaatattggcatggatgagtgtacaaatactttcaaaaagaattacaatttctctgtaataactatcaaggttatttggctaatagggggtccctggaagacctttaagacctgtctgtaaaagaaaaggaacgctggcaattcacaagacacctcagcaatgtagcatctgctcctggggcaggtaacaaaatccagttttaaattttgctcttaacagttaaggagataatcaagtcagcttgggattgggttgtgcacaggaaggctgcaaaaagattacaaaatagcctccccctggcagaaatgtaaaaaagccattccatgatttttttttttcagttctgccaacgatttatcttcagaagacaagcagatgaggagacaaaacctactgatgtgggtacccaagcaggaacccccctcttgcaccggcgactcacgtgggaagaaggtaggaaatcaacagcataggggaaagaaaaggaaaaggagtttggaaacaggataagacaggcttcttttgaataatggagaggactcttagaaaaaagaaaagaaacagaataaatttttattcactgattccatttcagcgcagcaaattctcattgattttaatcaattgctttcttacagagttttgtccatatgtatgtgacaaaatcagcggtcatttaatgacagacttagaatgtgtgctaagaatgaaaccattgagatttccttgtctttcctcctttcagtaaaaatcatgaaggggagaaagggagggggtgagggtggggcaaggagagcaatattttataaaagtgacaacgcgttttgcatttgaattattatttattttccctggtggagtttcaagcaggttattgcaaggaaaggaaaaactggaaattaaccaaacgtggtccagactggggatgacgagtttagcaggggctttaatgggacctcctaagcgattcaggagagaatgaatctctcatagtttcccttctcatgggatcactgaccaagcttccccaaatcagggtgcagcaacaaaatcagggtgcagcatcttttaagtgggcttaagacccacttaaaagcttatcatagcgagatgttgagaagataaagttttagttttttatagagcagaaaatatatatgagatgaggaataaaaggttctgtctaaaagcctgacatgtgtaagactttccctccactgttgttttccttttggtttggtaagaatgtggtgagtgaagtaaaaagataaggagagaagaaccacagagacccccttgaagcgtaaaactctgtttattaagagtgagaatgttcagtggcctgtgaccctccctttcctaggccaccttccccagtgcttggcttttccctgcctggcaccgggtgatccaggcaaggccctggctggggtgccgagggtgggggagacagctctgggtccttctgtgccacttcctccctgtgctggtgtttcagcagcaatctgcccctctgcgatggcagcctgtccacagctctagtgcccataggcttggggaccccgttccttcccttcatctgactcttcaggcctagagtggcgagggcttcccactgtgcttgtctctgggtacctcggcctctctggctgtattttcttaaccctgctccctgctctataaacagacccttctctaaattcacctcaactctcttaatgggattctctttcatgggattctgactgacagagtgcggctaaaaatatctcaaacctgatagaagctgagaggagctgaaatttcgagttgcagaaacctggatgcttgccactatatagaggacagcaaaccatttattatttatacaatttcaggcaaataggctctagaaattccaggtacaaaagatctgaagagatgactaaacactaactaggattagttacattaatcacggacttttaaaatgaccagaaccacctgctgctaaattataaagtccaaaaagacttcaagaattgttcaaaactaaataatgtcaactctctagaatgatttattcaaatttaagtaggccagactcacaatttggagcacagctctttaatacatatagattctaattttctaaaagagaaatagatttgttacttgactattagaaaattcattgcatatttaaaaagcgagagaacttagctgtctgcctgttctgagtctgaggtgtaaatgtttacctcatcatacattaagtatctatagattatgctcaatactttttgcaaaatgtagcataaagtcactactcatgcccttaaaataggcaacaacaatgtaattttagaaaatgttaataagttttcctagcttttgattttttttttttttagctttggccttatcctttttttaggtagtggctggcattatggattaattacttaatacacttttgttgccttagaattcactgagctgaaatggagtgagagctaagatgctctcagaatattcttaaaatgactgtgctgcaaagaagcccgggtgaatagaagaaaatagaaggaatggtggatacaagtgaaggttaaaatgaggtaggaactaaatattatactggcacttggggttagtatttatgaattgttactctctggcaatgctctactcttttgtatcttcttcgggacagaaaattccgtaagaaagacctttccaggaagagcttgtccctaaacttatgggctcagggtttgaacaaagcgtctcttccaagaccttgtgaataatatgcatgtgggccacgtaacttcacaaagtaaagttaaacgaatgcattcttttcttgctattagaccccatttatcgcaccagctgttggtgatttcagcgcacctttccaagcctcttgagagttctgctctaaccacactgccccctagtgttctctcgctttggtgcaacgtgagtaaaaaaaaaaaaaccaccaagatttactttcaatatatacactgtattcatcagtgttttgctatagagaatgtaagatatctttctgtaaattatttagatatttaatcttatttatttatttatcccaataagatattaaagcatgctaagctggaatgattttttttcataaatgggtaaaagcaaaagtaaaagtttagatactattaaataattcctgatctaataaacggagacaaattacctaatatttttgagcacctattatgttagacatgtaagaaatactgtattacaagtgaagtctaagtaagcctaattcaatacttaacttttaaagttagaaacattttaaatatatttattaatttgatctcgaatttggggaaaacagtaaagatggaagagagaaaagggagaatttttaaattttacatatctaagtggctttgtattatgttttaattgaaaaatattttaaacaagtcaattctgataagatgtagaaattctacttgcagctttaggacaaagtgaattaaaaacaaaggctttctacttgaaatgtggccagtgtgactgagaaatggagtttctaaattttcatttcattttaattaatttcactgatttaaattttaaaactgattgatactcaattcagtcactgaaaacttttacgtatgcttgtaacaacttaggtatctgaatctatttttttcaaatgtaaattttaagatatctatttagattaaatattcctaataaaaatatagcattttaattgcataggctataagtgaaaaatgtacagcacatttcaaatgtttagtacaaagccaaaagaatgtaatatttctcattaataattgttatatttagtacatgttgaaatttatatttagatatgtcaaacaaaatatattattaaaattaattatattggtaaaaaaggctaatagtatagaaatcataactatgtattcctctatctgaataaactgagagaatcaagttttcagattattaaagattgaaaaattgaaaatatatctgttttccatggtgcagttcacataccactggtgataaattactttagccaatgcaaatgtataggctttttattgttatgcattatttgagcaatagtgaaaatgaaactgagatatcaaatctatgattttgcagatattgatgtttaggactacactacacattaattacagtgctcatgtttataaatttttagtaactttgactccaccattaaattggattagaaatataagttgcagagttttcttttttttttttttcatattttaaaataagctttatttagatttttttttaatattttatatttgcatccatgccttcgagaaacctttcccacgggaaaggttattttcgtctaatgttacccataactcattcgctatttgacgtagttctcttaaataaatcatcctttagtaactcttagaattatctcctaatttacaaaaactgaaatgaaaaggaactactaaatcattagcaggagtggttgcaatcttattttcttgtaagtaaagggaaaatgataaaaatcaaccagaaaagaaattcatgggcaagaaaagtattttctaaaatctgtctccgtagagaaagatgccagcttgggtcgctccccctcacccctaggctcggttaaacagtttggtcaaaggaggacagaaaagtccttatgagggcctcaagttgcagagttttctaaagcctgagttttactgtttctatccttctggtgtcacttaacatgttcctctgtccagtgtatttcctgtaaggtgtcatttaacatgttcctctgtccagtgtatttcctgtaagttgtagttagaattaagaacagcaccatacaatagaaatatgagccacaaatataatttaaaattttaaaatacacatttaaaaaaagaaaacattaaaattaaaattaattttaataatataattttatttaacccaatatgtcacaaatattatgtatgtagtcatacatacatattaaattttaaaatttaagtcaatattaaagtcaatattaaaaattattgagatagtttacatctttttttcatattaagtttttgctatctggtgtgtattttacgtgtacagaacatctcaatttggcctatccacatttcaaatgctcagtagccacatgggattagtactgaatacagtagacccaggtacatcatcagactgaggttcaatttttggccaaaataccccacaggtggtggtgtgtacctccatacagaagcatatgtctggtggcttttttgtgatgttggcagtcattgattaccattgtctacacccaataattcattaaaggttgcaaaatggcaatactcaaattttaaaattccttcttcatttattagatggagtacttttatcaagagaaacatctcatcaactgcttggttacttggaataatatgtatagggaagttaggaaaaatgtttgatctcttccttttatttgccagtttttaaaataatgattttggtttccttgcattttccaaggatgatcaataatattttattttaacagtattattaggaattcatgaatgttaatatttgatgtgcctcagttcattgcagagttaacttaattgcagagttctgatatcaccaaagccgtttatgatattccaggtccgtcttgtacacttccttccacagacctgtaatcagctatttcttcagggagcctgtgattccttttagtggaaaatggtatgtagagaacattatctgtgtgtgaagggttgagcacgttccatcttttcagagaacaaagctagaaaacatgtattttaataaaataatattcatcatgaattcatgatgtttcctattcaaattcaagtagaggacttttttcacagtgtccttttccctgtcaaatttcaaattttattgacatgaatataattattcatttgctgtattcataatacacatgtgcaacagtctcgaataaatagaagactaccactagcaaaatgattacaaaaatcagcttaagatactttgcagttgtttttgtcattatgataacattccgctaaaacaggcaaattattgtgttttacggtcacttgggaatagtccctttggtgctgttctgccacctactggacagacaggctcaataggcttattttacttttgatattcaggaatcactttattttaaattgaattttgctttgtaataatgcaaagttttacatgactctagagtcaaatttacaaaacaagtctagtttttctccctgtctcctcaatcttatttccttcctctacctttaaatattttatttttaaatgctgtgatttatatgtccattagtatatatttgtatataatttgtatacaaattatacaaaattgatatatatttgtattttttatcccgtctcctttattagataattggtagcatactatacagacttttctccacctgaaagaaacatacatattattattaaaagtttatatgtatataacctggagtgttgggttttgctttgttaggtaatctggaaatatttttataaatgtaaatttaatcagtaaatttatttttaggatccaaatgcttggcatcacttttgtcatatttgttacatgtatttctgtccatacaagcatgcaaacatcgtcacatctatatacccgtgactacctctatctttattgccttacatttctactcttttcctatgtggtcaatatcaaggctgctccatgaactgtttgctaccaagctatgatgacttgtgaatagaaagtaacaaaaacaacaacaacaacaaaacacatttagaaacatttaaagtaatttgatattgccactaaattcaagcatatgattttgtatatttcaagtgtcgcttacaaattattggggggaaaagtggcccttcactacagagtctgagaagcacttgcctacattatttgcttgtgcgcatgtgttctctctctctcattatctttttgttttgtgttttctttctgagacagggtctcgctctgtcatctaggctaaagtgcagtggcgccatcatagctccttgcaacctcaaacttctggactcaagggattgtcctgcctcagcctcctaaacagctgagactacaggcacatgccactgcgcctggctaatttaaaaatgtttttgtagggaatagggttctcactttgttgcccaggctggtcttgaactcctgagctcaagcagtcctcccacctcggcctcccacagggctgggattacaggtgtgaaccactgcacccagcctctttttgtatttagaaatgtttgtgctattttgttctgagccctttttattaacatcttcatattatctataattttattaatatctgtaaataatacctttagtcccatttttacttttctcatcctactatgaataaaattgaaattagctaataaccccttcttcactttctcccctgttccctggcatctattttcaacggatatgtttttattctccattgatatccttgaggcaatcacagagcttattctactttttatattctctttccagtttatgcccctcctcattttttgacagttaattgtatatagagcaaatggccatcacattttgtactctctccctcgtaaactacaggcattatgagttatacaaaaaaatgtctacttaatgctcaccgccagttctattgtcgatgattctctagtcatattggttttccgaggcttggtctccataaattccccaggaaaggctcataggaacattactccctgagttgttgtgtgtttattaagaattgtgaccatggtatttaaagatcaatgttgctggttataaaatctttagctcacatctgctttccttaatatttctgaaatattttataccattgtcttctggcacaaagcattgctgtcaaaaagtctgatgacaatctgattttccttctcttataagggatattgactttttaactagtgccaaaaaaaccttttttctttttatttaaaggtcaatagttttagtagactgtttatatgtagtgcattctgggccagttttaccaggtacgtcctttcaaatgttgggcaagtgtatttttatgtcagaaaagcagtctttgaattataattgataatatttgttctttcattacattgattttcttttttaggaacttctattatatgttcatttgttctcctattcctattttctatgccattttcatatgtatgttttaaatctttttattttaaaaatattcattcttttcttttctatttttcttaaggaactttctgcagtgttcattcactattttatttcttctagtgtagtctaaaattttggaataagttttttcttcaactcttaatatttttctatttctataaactccttttgaagtctttgttttttcaaattagcttctttttgagttcttaaaattctgggttatgctgttctttaaaagctgctatcttttttttcagcttgagttaaaatattaggctaaattttcttctgttttgtttgcaaatctttctggcatgcttttattgtctgcggagacattacattcctcaaatcatttttctttatggtagattcgatggccatttttttctttattaatgtttaagtgagatgagttttcttgtactcttaggagagtgaaccaggatagcttcctagctctagagatttagagctgccttttctgttatttttggatgtgtttacaagtatgtatctgctatctgttggctctttgctcttccctccacttgcatctgcgtcttctttcttttgcctcctttgctcctatcatctatttcctgctcaatttggattctattccagtagtttctcctcaatgtggggttttgctgtggaggagatggctattaagggtccctttagggtccatggggcacaggctcctccagcacaagctggttctcttgggttcacccacaagttggaggcggcaggactctaggggtttcagttgcccttcccagagtggcccaccaagccttacagtgaatacttgtgaactgtttttgtttctctgcctcttggggccatcagaagtccctttgtcctctttttatttcttctgatgtgttgaagacactgtacaggtcttaatctcaccagtagtttattacaacccacacatatttggtttatagggatgtgttttcccgctgctttattggagatgttgtctgggaggtcttgcttttgctatcttagttgctctgtttccatggggtgatttggagaggtggaaaaattatgccaccttgccaccactttcctaattactttaagcaaccaaaattttagcaacgaaacttttaaattactttaagcaaccaaacttttagtctatttctgttgtactttattagtaagcatctacctgcctgtctatgttaacacgttttctgatgcactatacagttgacctttgaagaacacaggtttgaacggcacaggtccatttacatgcagattttcttctgcctctccccggctgctgccaccccgagacagcaagaccagacccatctcttctccctcatcagcctactcaacgtgaggatatggataaagacctttatgatgacccactccacttccagttaatgaaatatatcttctcttgcttatgattttcttaataacactttttttcctctagcttactttatggtaagaatacaatatgtaatacatattacatataacatacaacatatgtattcaatgacgatgttatcagtaaggcttccagtcaatagtagattattagtagtttcgtttctggagagtcaaaaattaaacagaattgtgaccctttggggctggttcccctaatcgccacattattccggggtcaactattgtttaatcagcatggtcatattgacgtccatgcatgttgttaatacttgagccctcaacagagaatatgtgcacagttcagggatctattgatgtctttctacactgccaggtctctatctctctctccccttcccggtctgtgaaaagtctctgcgtgtctctttgttgccactatcttgagtgttctggatgctgatacaaggccagttgaaggtggattgtccatctgaagtgctcctgtgtgattactaggctacaggacagtcacaaacatctctccttcctttcctcccctaagaagctttgagccctgattcttcaccagggtggtagaggataagtcttagagaaccatgacccctcgtgggaacatattaaaatgaggggggaatatactgggaggaaacaatagtttgataaaagcttcccagttggttctaacaggcctcctccgggttgtagttggatcctctgctcttggtagagacagggaaggtgccatggaattggccatgggtccagatcacctggacatcctcaggcacaggactgggaagtgactgactgagatttaagggataggagaaaagagagaaaagaaggcaggagcccaaggatgtaatttctttttggacccatcttctttttcaggtgcttaatatcattgtttttttttttttttttggaagttaacagatttatcttgaaagcatttgttgttattcctgcttaaagtctagctaagaaattctttcaactctaaacagaaaacaaagtatttcattttacaggtagagataaaaggtattgaatgggaaagtttgaaagaggtggcatttggggtgaaagtgtctccatcaaagaaaaactgatgacatcagatctgtggctgttttaatagagggagagaatacaggaaggcagaggggctgggaagggagatgtaagagatagggagcagcaagtggatgctggaaatgaccataaactgctaatttcataagtgtatttatcttcacttgtgcacagaaaaataaaggcgctgtgtgcgtgtattaatgctctatatgaatgccaggactggtgcagcctcaggctctaaggaaggaagatggtcaggtatttggtaagatgatttgaagacagagaagtgtcaaagaactgatggtctgacttgagtcctggtgtatgatgtaagagcttaacagactataatattcaggataatttctgaggaacccacagaagctacagtgtccagggcacgttagtaactgagggtcatataattaaacaaataattgttatagatggttcatttgtaagttagtagacatttctgctataagcaaaaatgttgtcgttttgacttcagagaaatagacaactttatatttctgaggcacttatgttttctctattgtggatgatgtatcttccattactaatgaaggatcataggaattgaggtaattgaaacacatttctcctctctatggtattaatatttttcccagtgattgtttttcttttcctgtttcctggatatgacagagcacatgatataagtacctaatcactcggggaacagctacccccgaggccctctgccttcctcctgctctccggggagtcccttcttcccccttcccttccgaattaacctgttctttaccgggatgttaacatcattcagccgctttccccattcaaggttagtgttccatttttagccctgaaatacacatgaattagattactagactattcactgatcaataatgtgaaaaaaacaaaaaagaaaaactatgagtcagaagaggaaaaatagtgactcatcagacagagggcgtctctattctattaatttcaactgcacagtctataataaccagtgtgtgagagtttcagccttcatccaaataacgtatgtgaaaccacaaaggaattcaagctgcagacaacaaggcacatttaagaggttacaatgttagtgttgagcttggggacatagaatagagcattgatttctgataaattattgtgtgcattgacattttcggcacaggcatttctttctatattatggttccataaaaaagtcagtttgggtccattaattgcctcagagggaagggtgtgtgtgtgtgtgtgtgtgtgtgtgtgtgtgtgcgcgcgtgtgttaggtggaaaggtggaatgtgctggattcgggaggcgtagtgggatgttggccttttactttgaaatttagatgtacatgcctaataacgttagccttttatattttaatttaggatatctgggctccattcttcccttactgcttcccaaccatgacttactgttcttagcgccgttgtcattcaatcaggaattctctcgagcagaccctctagtggcattcagtggatcccagaagagatttagcctgttgggagcataatgcatgttttagtctcctggtcacatacaaatgaaataggagggggtgacaaaatataggaatttaggagcgccctatgacttgaccttcttttgcacattagacagacttctcagatgtttgaatcttcaaattattatgtctaattacttaaactgaaaaggtctaagactgaattcacttttttcctctaaacatctttccttctgaatttctttgttgtgttttggtgatactctattccccagctgcccagttttcctaatttttaaaatatatttacccagttcaattatttattcaacaagtatctattctgttggcatgttgtgtgagtcacgtactgggtactctgggatggagagataggttagtgcccaccctcgggagttcacaatttagcaggtccctttctgcatcctctccctcctgtcaagtgcacctgtgtctttagtttcttccttcccatccctattgcagctgctctgataggagccttctccatcacacctggcccacagcaatcaagtgctccatagtctcagggagcctaaaagctacagcttcaaaatccagtttctcactctctaacctcttccagtagttctcaaccttggttctgcatcaaatgtattggtaatttttttttatctgtctgtttttgacacggatgcctaggaacccttttgtagagggcttggttcatatgtaatctctaaatggtgatttccttgggcttccagacaagagacagttgttcactcctctgtgtgtctagttctttgtacttcacttttactgattacattggtattcctgtgccactcagtccatttcactagaccatgacaacactgaggccaagaaatgctactcagctttctgtaagtattagttccttttaccccatctttaatgcctaatgatggacagtaagttcttgccacatcttcattttatgaagtattcttctcttgccattttgattacagggaaaatagcaactatgggagactagcaaagcccctgcatcctgtttgtcttctagggccagagcagggctaaactgtgtttgaaagaacagaaaatgagttgttccaattttctcttagaaaaagtccaagaagcacttgaaattccagcattctcttctctccatgggaagcaccatttcatttctcatttcttcattaatactctcttttccttgtccccaagaaaactaccactctgttctcaccaacgagtataaagttgtttgtttcttgataagaacagaggtcactctaagagtgctccagctgttgaatttttgcagtcacagttggaggagggttaatcatagttatcgcaagcagcctaacttatcaacccttttgagttatgtgtccctgggaaaattagtgcctctgttccccacccaacccctggctttttttttttttttgagacagggtattgctctgtcgcccaggctggagtgcagtggcacgatcacagctcactgcatccttgacccccagtgttcaagtgatccttctacctcaccctctcaaatagctgagactacagggacctaccaccatacctggctaatttaaaaaatttttctgtagatacaagttctcactctgttccccaggctgatgctgcactcctggcctcaagttatcctcctacctcggcctactaaagtgctgggattacaggtgtgagccactgcacccagacacttcatggaacaatgcagtgttctatgaagtgcaatgtttaactgaataagaaacatacagtaattgtatagaaatagggctgtagtgaggagtgaatgggataacaaggttaaaactatcaatgtagcgcctggcccatgctaagcactcaatacaagaataaccctggtgacacatattatcttcatcatagtcagatatttcgaaaagactcccagggaataattatgggctttggagcccagggcagaggcagggcttcttgctcctggggcagctccaggaggtgctgactggaagggttgaaaggccaaggtctgaagagtggctgaagagtgagtgacccttaagggagcatttgagttccaacccccacgtttcccctcgtgctgttttattactttcttaaaatcatttcattgctggccgggtgcagtggctcacgcctgtaatcctagcacttgggaggcagaggccggcagattacctgaggtcaggagttcaagaccagcctggctaacatggcaaaaccccgtctctactaaaaaatacaaaaattagccgggcgtggtggctggcacctgtaatcccagctactcgggaggctgaggcaggagaatcacttgaacccaggaggcagagtttgcagtgagccgagattgcatcactgcactccagcctgggtgacagaacaaggctccatctcaaacaaacaaacaaacaaacaaaaaaccattttactgctatgaggcatcagaataaaaccctaaagttttctcaaaagggaaaatgtgtgtgtgtgtattggcttgctattcggtcataccatggtgacttatgtcaaggatttataaatacttattgtgcaaacactatggatcctagtcagcattcactcaggaactcaacctgcctgtatttttaggttatcttgagatttctttctattattattttgcatgtaagagtggttcccctttttgcagcttctttttctgtcaatggcaagctaaaaacccacatttggaaaatatgactattcatttgcttaattatcacataaactattttttaaaattggaatcagtcactaacaaatcctgctgggctgtttcctctgtctggactcctcacccactgggatttttccactgaactttatgacatacagtagcccccaccttatccatgggggatacattccaagatcctcagtggatgcctgatgccccaaacagaaccaaaccctatatgtaaataaataaatatatatatatacacacacacacacacacacacactcacacacacatatacaccaagtaacaacaacaaagttattatgtccagctcttccgtaaaataaacatcaacttgtcatctctttgtaaaactgcacatctagttatattttttcaggtatagttaaacaaaaaatacctattttcgcaaggtatttgtaggccatatagttattatctttgaatccaagcaggaaggcttagcaaaggctctgtacagaaagctgtcgtgtcttgtatcaggctacaattttttttaagttaaatttcccaaagacaggcacagcagttggatataaatggcttctgaagaaatcacatctgtctaaaaatgaaaatcatttttcatgcctagcaattttgaactttccaattgctctgtgaaagtgttttattctcatacaatgaaaggcagaaaaaccaaaaccagtgacggggaaaaaaataacaattcctatacaactaccatatgcttttgatttaggtagttcagtgctcaatatgttgcttttttgtattcgtttttacttttctgacttttaaaccaatgcacaaaatgggaactggattattcaaaggtagaagaagaagaagaaatgctgctgctgatgaagccttgctacaggacgtgggaagggagtgacagccaccgagtctctctctttgtttttgaaacggagtctcgctccgtcgcccaggctggagtgcggtggcgcgatctcggctcactgcaagctctgcctcccgggttcacgccgttctcctgcctcagcctttggagtagctggaactgcaaggcgcccgccaccatgcccggctaattttttatatttttagtagaacggggtttcaccatgttagccaggatggtttcgatctcctgacctcgtgatccacctgcctcggcctcccgaagtgctgggattacaggtgtgagccactgcacctggccgccaccgagtctctttagactccacttgcgctccatgctcctcttgacttctgacccaatctgcaaatgagcggatgcggatcatcaggtcgctgctttcccgtctggcatcactaatcttgtatgaatagcattaactacagaaagcattcattgagatccatgtttcctactgtattgcagccgatactgggacaaccaccacagcagcagcaaacattgccttgctgttacacatttgtttattcaatcatttcctcattcactcaaccagcaatattgctgaatgtgcctggtactctcctagatactggagatagagaggagcaagaaggtggggtgctttccctcaatgaacttaaagtctcctggaggacacagatctgtcataacatgcccatggcaggatagggttctcttcctcctttgttgctgtatttccttcctctcctcactctattggaagtagaaaatatttgcataataacaaacggaagttatgccatgaatgggattcatgttcccatggtagggatgggtttgtttagtagtgatttcaagctgaagaatgacagcatccaccaccctcccaggaatgggaacctttaggtgaatgagtctcctcaccggaccaagggaacagtagcaggatggagctggatcatgtatggacagggaggtagaggagaagagaagagctccaaaggttagaaggattcttagactcccatatctggctgaatttctaaagactaaagatgtaaagagggcaagtcatgatctgcactacttacaagatcatgcaaattctattctagaacttgagcatatctgtgatccacaaggagcacaattgtcttgttttcttgtaacagactctaccacaggacatgatacagggttacacaccatttctctaaatattccattgagataaaagtttgtaatcagatgattcttaatctgatgttactttgattgctacacagtttagtgtagtgtttgctgagaaggcaacacaataaaataaaagtaaaatcagattaagaatcatcaggattgctgggtgcggtggctcagtgctgtaatcccagcactttgggaagccaaggcaggaggattgctagagcgtatgagttcaagaccagtctgaacaacatgggaagactctgtctctacaaaaaaatattaaaaaactagccgggtgtggtggcacaagcctgtggtcccagctacttgggaggctgaggttgggggaatgcttgagcctaagaggtcaaggctgcagtgagccatgatcgcgtcactgcgctccagcctgagtgacagtgagactctgtctaaaaatcaataaacaaaatttaaaaagataaagaatcatgagaatgaagcatttgaggcaacaaaaagcataggaatcatacaactgtgtggaatgtatatattttttgctttcaactttatttatcaaattttcaatgctattggtcctttcagggttgctcgttagctcctctattctcataagaatggaggtggggatgctactacttcaagatccgcatctttttcctgtcccttattctcattaatgaattatcttattcatcaaatgtctactgagcacctatttatcataggcccttggctagtcatcggaaacacaaggatgaaaaaaaaaaaatccctccggccaggcacagtggctcacacctgtaatcccagcactttgggaggccgaggcgagtagatcacctgaggtcagaagtttgagaccagcccgactaacatggtgaaatcccgtctctactaaaaatacaaaaattagccggtcgtggtaatgtgcccctgtaatccctgctactcgggaggctgaggcaggagaaccacttgaacccaggagatggaggttgtagtgagccgagatggcgtcattgcactctagcctgggagacagagcaagattccgcctcaaaaaaaaaaaaaaaaaaaaaaaatccttacctgccatcagacgctctctgtctagttgtaaagaggtcgtgagcatggtgaccccgcttttataagtgccaccggaagggagagggcgtgggagagaaaaggctcaaggggggtgcagccaggcttttctgaagtgagagaagccttcccagaagacttgatgtaggtaaaaggctgtttagaaactttctagattgtcaaggggatgtgcatatttcagacagagcaatagtacctacaggggcagcaataaatgaaataaccaatagtttgggatggacagagtatagaatgtggcggtggagagggtgctgataacagtcctctgggctgggcatggtggctcatgtctgtaatcccagcactttgggaggctgaggcaggaggattgcttgagctcagtagttcaagaccagcctgggcaacatagtgaaaccttgtctctaccaaaaaataaaaataaaaaaattagctggatgtggtggtgcacacctgtagtcccagctacttgggaggctgaggtgagaagttcctttgagcctaggaggtcaagcctgcagtgagccaggatcacaccactgaactccagcctgggtgagttcagtggtgtgaacatgaccctgtctcaaacgacaacaacaacaacaacacaaaaccaaattaaaaaaaaatcttctaacttctcagagaaaataacagccatgagcataagcacccaaagtcatgatgcatccccaaatgtgatgagacctgtatccacatttatttctaattgtggcatctcaactccccacacccaacagaacagttgactctacaatgtccttgggcatccatctctccctttcatccctctaacactgcttgaattcaagcccaatccttttccacctggtgattaccaaaacctcctaactgcttccagtctcagtgccatgcccacctctcctggcctcttcagtgtcctcccccagccaagggagtgaatgttctgaaattctcagaatattctagttagtgaatgttctaatacatctgcttgttatacgcctgtctacgcatagcacagactttagtggatccccatggcccgaggcaaagttcaggctcctcagagcagcactgatggttcagactgacacctttgcccacctgccatccccccctctgccacttccacacaaagattcccccagccactgcaaaaacatctgccactgtataactgcaccacagcctcacaacacggaatggcactgtggacagtttcagcagccaggcctgggcatgagacatactccttttcaggttccactggctatccccaagctacagagggggcctgggaaatgcagtctggctgtggcacaagaggaagagaaagctggtattgctgagcagcaggctgtctgctgtgggtcctttaaactggtctatgtatttgacatttgtctttttctttttattctataaattttctttgactatcttgttaacagattgctcctgttctttttttttttttttgagacagggtcttactctgttacccaggctggactgcagtggcgcaatcttggctcatggtgtcaaaggatcctcctgcctcagccacctgagtagctgggaccacaggcatgcgccaccatggccagctaattaaaaagaatttattttatagagacagggggtctcattatgttgctcaggctggtcttgaactcctgagctcaagcgatcctcctgcctcgtcctcccaaagtcctgggattgcaggtgtgagccaccggtcccggccctatttatattcttctattgtgattgcaatatcctttcaatgttctgtgaaaactaattgagtaatattaagttgtagtttctgaaagttttcttatttaaaaaaattctttctgtttccattggggtcatttattctgaatgttcgttttagccctagtgtgtcttgtgctgttggggtacctcaaatcatgattgcaaatgcttgcttattgtttgccgggtactattataagcatttacatacgcaatcatttaatatttaaaaagcctctctaaggtaaggactattactaacctcaatatagagataaggaaactgaggcacagggtttccctcacacaggtaaggaaactgatctgtgcccaggtccacacagttagtaagtgaaggagctggacccaaatccagacagtctgaccctacagtcttcctttcaaatgggtagtgcactttggatatctgtttgtggttaaaagtttcaagcactaaattagtcaatgtaggcagttgtcagaggctttctctgcttttgtgtaaagaggacaaatcacaataataatttctatatgctccattctcctcaactctctgacatttctttttcttttcagtgcaggtttctcatacttccggagaaatagaaagcaccagatgacagccaccacacacttttgtccccattgcaataggatgcttctaacaatcgtaaaattatgaaacactgaattccttaaaagttgtccatttgtggatttatctgatggtaactattaaatatttaaaagtaactttaatgaatctacttatgatgattgagtaatctattctctgaattccaccaaaaaaccattttatgaccacagtcataacgaacatatttctatagtcctaagctggcaagataaatagagaacagttcataatataaacaatatatttatttattcctaaactaataagatgactatcaatctgtaagagactatgaaaatcaataccgtatacttggtatagttggtgagaatttcaggagcatgtttgttcttttatttgtgttttggaagatacttagcccacttttttttttttttttttgagatggagtctcactcttgtcgcccaggctggagtggagtggcatgatctcgactcactgcaacctccacctcccaggttcaagtgatactcctgcctcagcctcccgagtagctgggactacaggtgcgcaccaccacacccagctaatttctgtatttttagtagagacggggtttcaccatgttggccagatggtctcgatctcttgaccttgtgatctgcccgcctcggcctacttagccaacttttaaggacaagtccagccatccttatccttcacagcaaataacaaacatagtgatttgtgggggtgaagagatgttggtcaaggggtatgaaagtacagtcagataaaaggaatgtgtcctagatttgatagaatactagggaaattacagttaacaaaaatttattgtacacttcaaagtagctagaagcaaagaactgtaatgtccccaacacaaagaaaagataaatgtttggggtgataatatctcaattactctgatttgatcattacacattgtatgcaggtatcaaaatatcacatatccccccaaaatatgtacaactgttgtatattaataaaaataaatacaaacaaaaagacccaaatagttattaattatagtgtaaatattagactagagccattctggacaagcacctgttcaacaccatatcctcattttctggcacccagtagacactgcggaagtatttttgattggtcctgcagaggttctaccccaacctcaccaggtgcaggtggatgccaggtgccagcctgggagaggctctaagttctaaagagtgtgtcggtggatggtgtgctttcatcttttagttcatatggccctgccttttattaacagcacagaacactgggcccagactcttgcgagaacatgcctttgaactgtttgctgctcaccttttagtgaaagctcttgacagaaatattaaagagaaagtgtttaaaggatgtgtggtcaatgcattcctgacggtgactcttctgtggattgaaagctctgaagtcccacgctggaaaaacacttagagagacttacagagataatggtgtgtataacttcagaggcctgtgctctctcttgaagtgcatattgacgccctagagggttctgtccatgatgaaaaataggcttcagtttttgccatctctaatcaattggtagtgaagaccaagagcactgttttgaaatggatctgagcctagttttgtccaagcagaaaagagttctatgatggatccacacaccctaagttggggtgaggaagctgctgggccacgggctatgattttggtatccttactctggaaattaaggtagtctactagcaagctgtgtgtgttgaccacacactttctaatgtatccagaacattgcttccattgagttggacttggtcattatatcctgtttgcttttagggaaaatttaaaaaagtttcccatgacacctgccttcactttttttgtcagaatgtcattgaaaaacactggctacgacatatcagaaaaaatgtccttgtcagacctaagtgtcaggaaaatctttgcttcactgaagaattttattctttcaggacaaaatatgagtgacataatatacagtattcctctttgcttcggcttttaggaatatcagcttaatgtcaacaattgcatagcacactataacaaaaatcatacaatgatactaatttttatttatatctctatccatcaatctatcccactgttgagctaacaattcttacaagccactccaaattctttgtggaacaaatcaagatatataaaggtaaacaaataatattgtatagatgttgatattttaattctcccatgaaaaacaaaagttctccttcctttggcttcagaaaattcattaattttccaactttaagactgaagagtaatgaacacatgctatcagcagatttaagtatctaactacagttcaagccttccctttcatattcctttccagtatgactgaataacttcttttccctagagacagatatttagccttcaattttatataggagaaagaacacaaaattttaaaatataaaagcaatataaatctacagtggtcttcagagttgttcatttttaatataaataaattactagttcaaataacttctccaaaacaagtttcccagaccaccaaggcagccgctggtgagcggcctcacctgttatcatcagtcttttctcatcacacttccctatttaagtgtggaattgttcccagttcaaagatatatgggagagaagtggctggatgggtaggatacacagaaaaccttgtgtacattctttgggagaagcttctagagaagaatctgagccacaacagattacccttggggaagtttgtggctatcatcatgaaggaaggcttaaccattacacaaatctttggaatacttttcttctgaatttcttaggcccaggaggctctattgctcaagttcattttgaagcacactggtttcaagacctgcgtaagtgttccttgaattaaaaaaaatctttctcaagctctaggtatgctgacaagtttggtagaccagaagtgtgatacttctacctgcgaggctccagcggagtcagcactgcaagggagaaggcagggctcctgagctcagttcagggtcagtgccttacttcctgtgtgatctctgcaaagtgatttagtcaacctctcagtctcagttttctcatacataaagtagggataaaagtcatatccagcttgcagattgactgtgcagattaaatgcatgtcatgtaaagcacgtggagtatactaaaggctcaataaatactagttccctcccttcacctttcagcccctcatctccccagcaatattttcagatgaataagaggtgagaattttcagtcttatttacaccaaagatcacgtttgggtagtcaaaataaaagtgaccatataatctaaggaaataagtgagttatgtgttcttagaacaggacagaataattaaaagcaggcctgtgcagaaaacctggaaatatgttgcacatcatctctgcatccttccctcactcctccttctctctccctcagggtagtagagcaaagaaagtagaactcagggcagggcttgtgtctgttttgttcactcgtgtacaccaagggtgtaaaatcctcatacagatttgatgctcaataaatatttgataaactgaatactcagaaagaaagcagaaatggtttgggacttcatatcctgttttccctggagttcagcataaataaaataattatttctaacaaaaaagttaaagaaagtctttaatcttctaccacagaaaaaggtattggatttttactcattttcctcaagcacatacccaaaaaatgctcccaaacaaataaacatcagtaaacaatttctggaaacccaatgtagcaataggttacaaataaagcaaagagtgcccctgctgaaactgctgtttatcttgcaagggccctccagggtggagctctcgccctctcctggctcagccttaaacttcactataagtaagcagaatacagcggagacaagaggaagtagttcatttgcataatacaaacaaagactctcaggtgaatggtttgccagttatcaatgtttgctttgccgattagtgaaacaatctaccagtaagtctacctaaagcctaatgtgctatactttttttttttttccagaaagttggtcaatggagaaggcatcaattggcaacattcggttggaccagttaatgattcagtttgcttttcaaaagatactagcagacagcattaatcttatcactctctttaagtataatctggacgcagaaaatcactcacatgccttaagttaggttggtaaccaaaatatccattgtttctctggatactaacaacgattatattaatagaaatagcagggactgtgaagattggctatgacaagtgatgctgtggtttactctgacttaggtttgcttccatggaggtctgattgtgagatggagatctgtggggagttccactgggatgtgctctgggcaaaaccactatgacagcagtgaaggaagaaggatcgggtgggaggggcacgctggagtcccgagctgggatgcccttcagaactggcccaaactgaagcagtggggatgagtctttgtatcccccgcagtggccagacattggatgtgggctgcccagggaggaagcatgacctcgtgtgaggcagctccctttggccaaaggcaattttccagaagggatacagctgagagctgtcaggtgccaccaattccagcagctggcagaacgagtaccttggctctgaaggagtatctgggtcgccaactacagcatccgctaaaaccggcaagtttaaataacaaaatatttaggaatgagtacttcccatgtaacctgcatataaaggacatttaacaaatatttgtcgaatgaataaatgagtggttattaggatggaagaatgatcagtagtggatgtaaactccatcagaagggatttaaataaggctgaagacaaatacagaattataataataaaccactcagagcagaagaactttcagcctagatatctgtattatgacttcgtcattagatttaattattcgaattctgaatttaagctttacagcaaaagtagaggggaaagatggaaaaggtactccgatttggggggtcaaggttcaataagtgagggttccccactcacttggaaagggctatcattctatacataagaatttgacagaaaaactcaaggctttaaaaaggaaataattagtctgtgtgaagcagctgaaagaagtgaaaaacatcattgactgaattttttcaaaattaatgactcttcctgcttggagctctttcaactacagtaatcaacatctaaaattcttgcgaaggtcatttctgagcacagtctattctgctccatctaatgatccaattcctcttcctctgagtgtctgggcatgctcatcttgcagccagccgtctaatcacaaagacattttcccgacattatgcattagaagatgccccttactttataaagttatataaattagaatctattttatccaggggcttatatggttaatttcaaagatgctttatcttcttttctcagtggtcttcataccaaaatagattctgacacttaacctataaacacttccgtcgcttaagatttatctgattaaaagcttataaatacacattttcatatacttacaagatataattttttatgcaaaagagtcttcttaaaatgaaaagtccttttcgttttcattatgcaaatgtgtattttccagacttgcctttataactcttcaatgtctttggggaagaatattctgtccatataaggcaaatataacttattggcacttcacagatttgtttctgtagcttaagatagtcaggttgtttgggggaatttttttgttctaatgatttaaatattttattctaattattagaatatatcatttaactagattattaagtagatacttcttctgtgttgcaggatcaatctttaaccagggtacctggctatgcctgtccaaggaatctaggaaacgagacacataggcgcgcgcgtgtgcgcgcacacacacacacatacacacgcacacacccccttccctcccaaaacctgaaatttcaccaagagcaaattctatgacctataaagggcatataattttatatatttcagggagacatagtacatccatcaatacatgtaagatttacattggtttgatctggaagggtgggacaactcacgttttatgtagatttaaacatattctgattggcaactggttgagtttttatctatacaaaggaatgtctgggttatggtaggggttgtggagacctaggttttatcgtgcagatgaagcctccaagtagcaggcttcagagagaatagactgtaaatgtttctcaccagacttaaggtctgtgttgatgttaatgctggaggggtattgtgaggcatgtccaacccccgacttcctgtcatggcctgaaccagtctttcaggttaaattttagagcgcctggctgaggaggaagtacattcagatggttgtgaggggcctttgaattttatttttggtttatcgtcccaaggtttagctacatgaataataattctatgcttttaaaatgttaattcattcattctacagacttcttgagtaaccgttatgtgccaggtcctgggctggggaggaggacctcatataaattaggacttgatgtagtttggatatatgtccccactaaatctcatgttgaaacataatccttggtgttggaggtggagcctgtgaaactgccttagcaaaaattataactgaggaaattatgacagtgaaagagacctgacctaaccaactccatcttgcttctaacctctcagctgtccttgtttattcctgggtgtaggccaaactaagcttgggaaggaatttagttcatagtttaactttgaaacaaagatgataataaatccccttcttaacgggggaccagtcggcctttgtaggactaagaaactagttacaagattagaaattacagttaggagccatacggcctctggttgcaagagtctgaacctccccagattgctcctgggaataacattactgttgtaaaccctaagatcagtgcttgagttattttgcacaacctgtgttctgttctgatggaccagctgacaccacccagactggtaaactggttcaaccagctcggcaatcccacccatgaatagtagaccgcaagaaaaactcacttcggcgccttacgatttcatctccaacccaagcaatcagcactccccacttcctgagcccctacttgccaaattatccttaaaaactccgatccccaagttttgggggagactgatttgagtaataataaaactctagtctcctgtacaggcggctctgcgtgaattactctttctttattgcaattcccctgtcttgataaatcggctctgtctaggcagcaggcaaggagaatccatggagcagttacacctggtgggaggtacttgggtcatcagggcaagtccttcatagcctggggctgtgctcaacacagtgagtgatttcttgtgagatctggttgcttaaaagtgtgtggtacctcccactgtctctctttctctcttgctcctgcttttgccatgtgacatgcctactcttgcttcaccttctgccatgagtaaaggctccctgaggtctccccagaagccaagcagatgctggtgccatgcttgtacagcctccagaacctcaagagaattaaactcctcttctttgtaaaattgcctggtctcaggtatttcttttcttttctttttctttctttttttctttttttagaccgagacttgctctgtcgcccaggctggagtgcaatggcgcgatcttggctcactacaacctccgcctcctggattcaagcaattctcctgtcttcagcctcccaagtagctgggattgcaggtatgggccaccatgccaggctaatttttgtatttttagtagagatagggattccccgtgttggtcaggctggtctcaaactcctgacctaaggtgatctgcctgtctcagcctcccaaagtgctgggattacaggcgtgagccactgtgcccagcctctcaggtatttctttatagcaacacaagaacagactaacacagaactcaaatgaatgagttctgtcctcaactgcagtaactgtaaggaggtattatcacattttctgtcccctagtgagaaagactaatcctttaaaactacagtaagttcacattgtatgagactcaagctgagctttcatgaaggctctcaaacagagttggtgtttttatagtattgttcacatgttcttaattttgttttttcctcaacttttaaatgttcagaaaacttttttaaacatagactttagataagaaaatttaagatgattgtgaactgcatgatattttattatcgtcaatccacagaatgcttctattttgtttcatttactttggttttactttgttctctattatcttctgtctctaatctcacagccccctccaaccatagtcagcttttattatatatatatgaaatatataatatttataatatatatgttcatccattctaccttttacacacacacacacaccacacacacacagagaagatgtgaaaaatttttgcattcactgtgcttaatttacatagatgatactgtggcataagtatcttctaacttttcttattcaaccctgtttttaaagatctactcacgatgctacatataagtctaagtgattgctttttacattccatcatatgccatgctattcatacattggtaagtctactaacagtaatagctctgccatgaacatgaacacaccttattcttgagcacctgagtgatttgtggagggtatatttagcagtagaattggtggattgttgggtgtatccacactaaatgtcagcaaactcagtgagattattttcccaaatagctctgttagattatattctcaccatcaaggtatcagggattccatttctatatatcttcaccagcatttgatgttatgcaactttttagtttttgtcaatctgatgattatagactgacactttatcaatgatttaattagtattttccttagcagtagaattggtggattgttgggtgtatccacactaaatgtcagcaaactcagtgagattattttcccaaatagctctgttagattatattctcaccagcaaggtatcagggattccatttctatatatcttcgccagcatttgatgttatgcaactttttagtttttgtcaatctgatgattatagactgacactttatcaatgatttaattagtattttcctaattttgaaagagtttgggcatcttttaatatttactacccatttaggtttctcttgctgtgaattgcctattcagagacattgcttattttttttctttaggttttctttctttttctcctttcttttctttttaaaaatgtaccatatggacagtctttttaaaaggcttttaacactaggaaaactttgggctttcctaaaagctatacaactgtcatgggtaaactttattgcattgactttgactttcaagaaacctacagccatatttgccatgtaatcacagctgtgttttccctttcagcaagtgtattcgcattcttgtactttcttggaacctaatttttgcattcaatgttattattaactttatttttatgtctcttgtcataacctgactcaaaagatgttttgaaggagtcaggcacaagtgaatcaataagcttattttttttcaaaatgttccagtttaatttaaattggtcttcttgctagaacaaaatgtgttcccactcaccttaaagtgacaataggcttctgaattccatggctgtaggtgtcatctagttcaacaacacgcttttcaaataggagatggaagaccactgaagtcacctgaagctgtttaggagacacaggctggagcaaaactggaatggcctagcattgaatctggtttctcttttctttttatttattaatgtaataaaaaaaattttggtttctattctgcttagtagaaaaggtttatatatggatcacatgtctgtgtgtgtatctctgtgtgaaagtgtctgttttttgtaaagtttatgtatttttcttcccctctctcattggcatttatctcgatgtaattgacttgaggtttctggtcttggtaaatttcctattatttcaaaagctttgaaaaattattaaatctaatttagaagtgtaaaattccaactcaaactttggaagtcaaattaaaactcctctctttggtaatctctgagatagtatatacaaatatcatccctcttattaattgttcagctcttttcttaaatcatacatgaatgacttgtcaaagacaaagtattagcatcagaaagattctcagtatcaggacttggaggtcatgttgcacttcagtctggagcttctgagaatggaaccctgatctcccatcctcgtaggatccccactttcccggtgaggcctaaacaggaagggagcaccacagctgggaagaaccccatgttcctgatctggatcaagggagtgctacccccacaatggtgatactaatgctttttcacggaaactggcttccgagttcaacaagacaggcaaaggggacgtggcaaattcccctcttaacacttatgctcggagtgacatgtctgttcgtgctcacaagctggcattaaagcaactcacgtggccacatctgtctagaaggggtcaggggagtgcaattcttttatgtacccagaaaggggggagaaatattgggtaaagactactaatgactaccaccttctgcaaccctcactttttctgactatgatgataatgacaccctttgcctttacatagtatagctgtgcctaatcaaagggcacactggccagacttagaggtgggagtgacttctaaggagcatggactttacctgggaaggtgatgggcttgctggggagctgtggtgttcgagagccagatggttgactcatgaaacagtaatccaggagtgaaacagaaaccaagttcttaggcaggcagtgctaccaagtcatcaatatgaagggaccaggcagagagcaggagactcggacactggggaaatcagacaaaacaagaacccacctacctgccctctgtcctcctgcctcccataagtacttcttgtgcacttataaagtggcaagcactattttaggttctagggatttagcagcggaaagacaagtagaggaaataaaaaagagtgtgtgaggccttgagtgtgcataggtggagtgaccctgtccaaggtcatgtgtgtgcactctacactgagtatttcatacccacggctcatttgaaacatacaagaactcaaagaggtgagtactgctattacaggttgagtatcccaaatccaaaaatctgaaatccaaaatactccaatgagcattttttttttgagtgtcacatcagtactcaaaaattttcagattttggattttcagatttgggatgctgatctggtaagtggaatgcaaatattccaaaacccaaaaaaatctgaaatctgaagcacttatagacccaagcatctcagataagggacactcaacctgtataaccatttttccaatgaggcaacagttcttcagggtggtaaagtgattggcccacggtcatgcaattgatccaagtcctggttttctgactctaaaggcccttttcattttatttttggacaataacattgtcatttttaacagaacaaacatattgtaagtttccagagtttagatctctgccttctaaggttactgttttccatctgagttctattttctgctgataattactaagttttgaaaataattcaagccatatatatacaatttataaatatcatatatacacatatataaaattgttttacatgactgctaagggattcttcaaactgacatttttaaaagccaagtgaatatattgaaggtatttttaaaaaacagttactttgatttgaaacaatctcttgttatgataaaagtagtctcatctctaaaatagccaaatatagacagccataagataattaaatcagaatctgttttctcttcccaggaagtgaatctaagtgtcaagacagtccccactcttttcaggcttatagtattaacagcatcacatcacaaaatgttgtcaggttcttgcggcagcaataatgctttcatttataaaaggtgaccacggttcttaagttggttcctcttgacctctgtcatctacacacacaaacatgcaaagtcactagttaggttaagttgaatttagtttaagaagtgctagaaaaaggcttctgaactgttgaaaccatgccaggggtcagtgggtggatttttcactaaaagggtcatacagatgtctaggtttttcagtgtgagatatccatattctaaaatgccattctgagcgggaagcaagaaagggttttacaaagcctactttaaaagtataatgaagccaaattcttctgctccagtttagaaggggttttgcacttttcagggtggaatacttaaaactcaaaattcacagaccaaacaggtacacaggacacaggtacttaggggttggatgttaccaaagggtgaaaaaaaagaagagtcgagagaataggaattttctttctatagcactatctatgagatggagctctgagtataagcaatcatttctggttctccagattggaaaaatcatcaggagatcacatcataatctgtgaagtagaaactatcctttagtggtgccacattttctatttctgattctttggacacacagggactttctgggctatgaaatagtctattcagtgaaactagttatcataaaagacatgcaaaaaccttttcacagtctttgtcctggaatatctcacaaaattaattataaattggcatgcgactttctgatttagcctgacaggattgttcctttccaaggtttaggcactaagctgctgttattaagataggaattgtacaggtggtggctcagccccaagggaggctcggcctgaataacctcactatgcagaagtagagagcacctggggagaagagacaggctccttacatcctggattaccctgactctactgcagccacagtgctgttcttgagttttatgtcaggtgaatattaacaatagcagtaggatagggtactagatagtcagcatgctttttaggaaaaagcacagaaattttggaggtttttggtatatcctaacatttgatttgtgtgatgtctctgaggctcgcttccccatttaaaaatagaaataatgtggtctggtgtggtggctcatgcctataatcccagcactttgggaggctgaggtgggaggatcactggaggccaggagttcgagactagcctggccaaaatggcaaaaccccacctctactaaaaatacaaaaattagctgggcatggtggtgcatgcttgtaatcccagctactcgagaggctgaggcaggaggattgtttgaatccgggaggaggaggttgcagtgatccaagattgccactgcactccagcctaggtgacagagcaagactccgtctcaaaaaaaaaaaaaaaaaaaaaaaaaaaaaaaaagaataatgatatgctctagtgaaattaaatgagacggcacacttacctagtgagcccagagtctggggcatggtcaggatgcaaaaaatgttagttccctcatactccttctcttctctgtaggaagaagtgatttccatcatttatgttaacacagattcccttgttatataaaactgtaatttatttgagatcaacttagaactttgttgttgcaaaaacagagagatagcaaaatgtaacataaaaaacacctcagattatggtgactcagataatttgctttccagctcagcagtgttagggagagcttgagtaatgagtgaccttgaatttgatttactccacttaagctgctccttaaaaccattctttgtggtgccttcaagatggttttgcttaagtagcatgtcttcctcaaatggcccttgataaccaatcagttgtggtgtcacctacctcaacagaaaagaaaaaacatttcaatctggagaaagataaagtgtgcttctttgctagaaatggctgtaaagtgctaccaagtagaaaaatctagaaacaaacccaagattgtcaagaagattctaaaacttagctcttcctttcctagatgaggggctgttattgcaaagacaatctgaggccttggggattttaacataggttacccaaaatatgtaaatatatagggaactgtctctctgtatttacatagctattcattacttttatttgtaactctatgcaaagcatatttatataaaaaaatacaaaaacacataatagaccataaaagtgacatgtggaaagcagcattaccttgctctgctctgagggggcatcagcctcctgacttgcttgtgcattcaggtggcagcaaatacgttattacctgatctcagttttaaaaaagcaggcacagggcacatcacgccaaatgttgaaatgatcaaactaaacagaaacttgcttaatatgaacagtgctactcaccctgacttgattatacaatgtatacatgtgttgaaacaccataccttattccataaatatatataaatatgtcaatacaaaagaaaataaaacttaaaagaaaaaatgaaatctgttatccttacatcttttttacctttatcacatccagtcacgcctcactgatcagtttcaggagatgaggcatcagtgtaattacattttccagactactgaagtttaacatttaagcactgaacccttttattgtaagcatttgtgatgggaagttttctcaaatgcatcacattatttccctgctttgtgaattaaatgtgctaaatgccatctaaccctttgtttttttccaagcaagtagcatttttacttaaattttttttcaagtatgcaatacattaacaatagtccccatgttggacactagggctcttgaagtcattcctcccattcaacaaaaattttatattatttgatcatcatttctctaaacctcaccttctccatagtaaccactcttttactctctgcttctaagagtttgacttttttagattacacatgtaagtgagatcatgtagtatttgtctttctatgcctggcttatttcacttagcataatgtcctgtgggttcatccatgttgcaaatgacaagattttcttcttcttaaggctgaatggtattccctatgtatatataccatattctctttattcattcaaccactgatggatgcttagactgattccagatcttggctattatgaatagtgctgcaataatcatgaaaatgcagatatcactttgatatactgatttcatttcctttgaatatatacccagtagtgggagtgctggtagttctatttttaattttttgaggaccttccatattgctttccataatggctctactaatttaccttcccaccaagggttccctttcctccacatccatctaacggcctcttaatgactccatttttattaaataaatagttgagtgggcaagaaactctgaaatgattccatttcccaggcctatccttgtattttatacctgaatgctagagatgctaagtgacttgctaatgcccacacaggtggatataccaggagctcaccctaatgcctacgtttcctaattcctaatttcagtgtcttcctagtagacataattcccaataatattgaattcttggtccttgctgttgttctcaccaggcaggttcttcccttaaattcaagtgtgccctaatgtctctcctacttcagggttttcctcatttatcaccttctcagtaaggccctccacgatggccctatttaacttggcaacctccttccactcatggcattccttttggttttctttgatttgttcttttctctacagcattgatcaccttctcacattctatttattgcctttctcctcccactagaatgtaaactccattaagaaattattattattttttgagacgggagtctcgctctgtcacccaggctggagagcagtggcgcgatctcggctcactgcaatgtccacctcctggattcaagcgattctcctgcctcagcctcccaaatagctgatctcacaggcatgtgcaaccatgcctggttaatttttgtatttttagtagagatggggtttcaccatgttggtcaggctggtctcaaattcttgaccttgtgttccacccgccttagcccagaaaatatttttgtctgtcttattcatgactgtattcctagggctagaatactgcctggcaaataataggtgctcaataaatacttgttaagaaaatcatatatggcagatgcacctggcagcagaaacttaactgaagtataccctgagaatgaccttatgggctaagaagaatgtgtgttcagagttccaagctaaggaatccaggaatggccaacccagagattcattcttttccagagaggaacatctgaacctccagcccatcccatggaatcgaggccatacaggggattgaggcctcttgttttggattgagtgaaggttgccaagtggaggtagctagttggaaggtggtaaatgaaattgctatgtaaactgtatgcttttggctgggtgcagtggctcatgcctgtaatcccagcactttgggaggctgaggcgggcagactgcttgagcccaggagttcgagaccagcctgggcaacatggtgaaacccattgtctaccaaaaatacaaaaaattacctgggtatggtggcatgtgcctgtagtcccagctactcaggaggctgaggtgggaggattgcttgagcccggggaggcggaggttgcaatgagctgtgattgcaccactgcactccagcctgggtgacagagtaagacacagtctcaaaacaaaaacaaaaacaaaaaactactgcaagcttttcacaaacggtagctgttctatccagcccatcgccactggaccaccctacataaatcccctcattaaaccctatatctcgttcactggctctgggtctcttctttggcctctcaaacatggcgccattcctattgaagtcagcaggggtccagcatgacaaatcattggtctgaatgacaaaacttgacagagtttgatttctgaataagtcagttcaataacaaagagatgtataagttattttttttctgctggtggagaagatatacgaaattatgtgttgagcaaagtctggtttgaaaaaaaaaggaaggtggagttttagctggttaatcagtatcaaaagttggcttcctattagatgatacaataaaatatatattgtatttacaaacatatttctaccaaactactgaaaacattggtgactataccatcaactaaatttgtaactaaaataatggccccctcatgaaaatcctctgtaagtgcacccggaaagggtaccatcaacgtttcattttgttcgcccaaaagcagtctcactggttcaatagggagctgttatggcccctttagaggcagttgatgggaaataagcaacagtgtttgtcaaggaaccatttgttaaaaccacaggggtggctgggtagtttaaagagtaatcttcagtaaggtgcatgaaagagctttccaatagtcagtttcaaaggaggatgagtctttgagggatctgtctgatgataatgaaaatataatgaaggttaaagtgttctttgcagtttttaccataggaaatgattggaaggaaactaacattttcaagtaaggaaatgattcataaattactgacaagaaaatagtgcttcaattaaaatgatgatgataaaaatgacagagcaactttgaaaaatcatatgaaacaatattaaattcttgacatatatgaaaccacatgtggtggctatggtcatatgacatatggtcatatgtgaacatatgcacacagataaacaaggtagcattatgagtaacaagcaaaattatcccttttctctagtttcccggttttgatacttcacattgcaaggaataaaataataataaaaacatattggtcatggggcatgagtgatattaacagtagtttacctaaggtaactaaggaaaacttgatttaaatggaaggtgattgctgacattttcatactgacatttgaaaagaatttccaaaactgtgctttctgaatttgcctgataatagctgcatcacccacagacctaagggatgtgaggtaaaacaagctttgatgtcttttggagattcatcatgcaactactaattaaagggtctgaaaatctctgtagtctacctattgatattgtgagaaaaccagtgttttacagtgcaccattagcaaacagtgcattaagcacacagataccttggtttttccccaataaagttttgaacatcaaaaaaaagaaaaataagaaaacaagacataacaaagctaagtccaggtttctttgtccttgaaaactttctgaggaagactggccttatatctaattgttggggtcaggaggtaaagaggaaacctctctccaaagacagaaacagctaaatcaaagcctgtccctagagagtttctacagcagggccggctaaaatccaggggtggatgatcatgtcacatcgtttggacacaagtcacttggaagccaaagttttaaggtgtatagaatggatttaggggctagtaggaaggtttctgagcccatgtactcccatcatatcctgtactatccactataggagtgtttaaattatcttaaggattgttctcaatagagtgcaaacctctctgtctctgtctctccgtctctgtaagcttcttgatgatagcaaacattatggtcacctttgtatccacagtggctgggtcttagttggtgttggataagtaaatacacattgaattaatgacagaaagcatgaataaatgaatgaatattattgtaagctacagaatatgaatattggatcagaggaacttattctttccaagtgcagctcttaaataaaatagtccttaatcaatgatatatttccattagattggaaggtacaagaataatagttctcaacctttccctagtttctgccctaatcattagttatttcatttttatttttattcattaatttcattcattatttttaatttcatatgatatgatgtgtaaaacattgaaacagttcagataaggctaacgtgtctcttgaccatcacccgccagttcctactcagagctggaaagcttggggtctgtttggcatacaagattgtcttcaaggtccttctattttaggaaatataaattacttaaaattttgtcagtggctgcagaggattccataaaatggttgtaccataagttatttagttttctcccattgatagacatttatgtgttaccaaggcttgctattatgggaaatgtatcagtgaacatctttgtatcctaggccagatactcagaaataaaactgttggataataaatttaaaaattcaaatatggccaaactgtcatccaaaaaatggctcaccacatttacattcctgccagcaatgtagagcatatgcattttctatatctctgccaaaatatttctattatcaaatttaaattatttttttccaaataattcgggtgaaaaatggtatcttcctttattttgcacttccctgattaccactgaagtttagcaactttttttttttttttttgagacagagtctcgctctgtcacccaggctggagggcaatggtgcaatctcggctcactgcaacctctgcctcccgggttcaaatgattctctgcctcagcctcccgagtagccgggactacaggtgcgtgccaccatgcctggctaatttttatatttttagtagagacaaggtttcactgtgttagccaggatggtctccatctccggacctcgtgatctgcccgcctccgcctcccaaagtgctgggatgaggggcatgagccaccgcgcccggccctttttttttttttttttttctgagatggagtttcgctcttgttgcccaggctggagtgcagtggcgtgatctcggctcactgcaacctctgcctcctgggttcaagcgattctcctgcctcagcctcccgagtagctgggattacaagcgcccaccaccacgcctggctaatttttgtatttttagtagagatggggtttcaccatgttggccaggctggtctcaaacacctgacttcaaatgatccacccgccttggcctcccaaagggctgggattacggacataagccactgcgcccggctgcaaatttttatatactatttgtcactgtatccattttagccaagatattattaatcacattaaaatcacattaaaaacataaaaatcattaaaaacccacacaagtcacaactataaattaactagtcctgttgccttattgtaagcaaaactgtacctttaaactattcacaaatatatagttgtcaatttggtggctcctgaaaagatctctagcattacagattttataaccttcctcagtaggaagttggaatgcttcctacttccaacacctttatagcaaagttggtcacctttctggaaaaacaggcctcacttcaagagaacgtcacttatttcactttgtaggtgaaccctgtctcactaacattgccttcttgtgtacagacatgaggtttatacttttgtagcctttgtgcctagcactgtggtgggcccatgaaagaaacaaatatattacaagtgtaatgaatttagcaattcagtcatagtaaactttcaaatgcctgaaattacagactctaactactttcccctgcactaaatgctaattcttaccaccatttgaaaaaaaaaaaaagtcttcttgttctgtccttgtgatagtttgctgagaatgatggtttccagcttcatccatgtccctgcaaagaacgtgaactcatccttttttatggctgcatagtattccatggtgtatatgtgccgcattttcttaatccagtctatcatggatggacatttgggctggttccaagtctttgctattgtgaatagtgccgcaataaacatacacgtgcatgtgtctttatagcagcatgatttataatcctttgggtatatacccagtaatgggatggctgggtcaaatggtatttctaagctactaaggaggctgagaacacaaggggggactgcttgagcctgggagttcaaggctgcagtgagctatgatggtgccactgcactccagccttagggacagaacaagaccttgtctcaaaaaacaaaaacaacaacaaaaacaaaaacaaataaagtttataagataagatacctgagttaggattaaagatactgaaatatcattaaataaaataagtcatatatgatgttttggggatgtttcacattccatggctactgatgagaaaaaaggatttttaaaaatctgcagggatgagaagacacaaaaattgattatttactccacaggaaaaaatatctaaagtgagaggagatcgtatacctttacttctctaggttctgagctttaggaatgttcctgaaataaatccgttgagctcagaacaacaggaaattgccacttacgcacttaaaaagctttcgtgctaccatgaaaccacctactcacttgacactaatcggttgctaatggtttctggctaggatttgattttctttggcttaatcaccaagggatcacctctttccagatcaatctcagtccactggctaatctgattctgtgatacagcactcagttctgttctatcttgaaagttcctaagtacataatcagtctaattttggtgacattcgattcaatatttacgatttatgtctactaagaagtagacataaattcttagtctactaagactaagtgtccaagaggacacttagtaccgggaaaacctacaggtatcacagatatgtcatttggtaaagggcatgatttagctatttattttcagggatggaaagatagaacagatacctttaaaactagtagttccatttgcaagttctatgacagcttttaatgatgtttattaagctgattacacactactgtacaaaagaagtccttgaaatgaggtaatactaggagaaacacagctggccatcaatttaagcatcctttaaaagcagatgtgttaaaactcaaagtgggtgtgaagaggacatgcaaatcagtctaaggtacaaggcactgcattttgaaatgcagtacttaggaagaatcttggagagcatttaattaaaactcttacatttaaaatgaagaaactgagtcctaacattattaaacatagttagaaaagattttttaacctggaatttggcatagtggtcccttccccaagtttgacagttcatttaacttaagtagaatttttcttgcttctgtatatcagtatttctttctcaaggatccttacaaagtactgggatgtcacttcacagattctttgccaagacacgtgattacttgcatcactgaacatgcgttctaaatactttttcaacaggaatttaagattgtcatattgacatgaagaatgcatttagcttgtttgctcttttaacagaaagtatacattttaagccacagctgtgtaccattcaatcattatgatttaagaatttttcagggggggaaggcctgaaagaaggggagttgtaaatttctcatgcttaagaatgatgaagaaaaaaaagtcagaatagaattcaatagcaaaataaagcccaacaggataagtattcaataaacaaaaatagcattattttctcttcagtatattctatccttcaaactctggcaacagtttcttaatatgagtgaattgccatgaaactgcttttgcctgacaaaattcctttgagtagtgtgcaaattgtaaagcctatttctctctgttcattagtaagagagttcatattgtatagtgccacagactctttgctcattgattgtgagaagtgataattggctggcactgaaatactagaaggcaaagttgtacttcagaagatgaagagagttgagaaacagtagcaacgtgtcagttaggaaatatactgtcaatgcataagaaggataaagaacaccagtttagggttgatttgcaaagtatatcattccgctgctgactacagaaagttaataattaatattattaatatggatagatggatatggagtctatactaagaaaaatggccagtttatgagcaaaagtggagaaggtgatagccattttttcaattcatgcacataaccagtgagtttaactttcacttacttatatgtatgtatcatgtgaagatttcatcttaaaacttcttagacttggttaaatccacattaattgatacatattatattactgtaacaaatctgaacatggattttttattcagttataattaaagatgggagcccttctcttactttccctttgttctgagctgcgccatgccttttctcttttgggggctcttcagcaaagacaagtgtccccagattgaaactctggatagaactttttagactcagggaacatagattaaatttacctttcagctgggtgtggtggctcatgcctgtaatactagcactttggaaggccagagtgggtggatcacctgaggtcaggagctcaagaccagcctggccaacatagtgaaaccccatctctaccaaagatacaaaaattggctgggtatcttggtgcatgcctgttgtcccagctactcgggaggctgaggctggagaatcacttgaacccaggaagcggaagttgcagtgagctgagatcacgccactgcattccagcctgggcaacagagtgagactccgtctcaaaaacaaaaattaccttttaactgccatgtgatcagaggcaaaaacatgactgccatatccataagtttcttttgatagtccttctataatcaatttgctcactctaataactctagatatgtaatcatgcaatacaggcatgattcttcatggctctaaagagtgatttcttaatcctagatgctacagttccaatgcagagaatcagtcctatattaaggcaaaagacttgataacacgtttcaaccaacattaagtaatgatttaaacatgtattaacttcactcattcagttgattctgcctattgtttcatgccattctttttgccagaattggtaacctttaataacccacattcatatgcattcagataaacacacactcttgaaggtaatatgtatgggcttcagtctgggggggttagggatgatgacccatttcatatttcacagccaataacagaagcctataggagagcagccacagagaggcaggaatgaaaaccgcttgcagatagttctgtgttaatttttatctccctccatttttcaaatcttctataaagtaggtttatttttaacatcttctcattctctttagtatgaggtaaaatagacaaaatgcaagggtgaaaagagagaaggaaggcagttaaggatctagccggtccacaaatattgaaggaataatcaagacacaacataaaaaatattttcaaaatatgttctggagtatttttcctcttggtaattcatttttcttcctctttttgccatcctgcctctgaggttggacagggatctttgccccaggtaaagaaagaaagatacagtccagaggtacaggagttctgcagagtggctgtatgcgtttcctctggctgtggtactgcaaattaccacaaacttggtgccttaaaaccttacacatttattctctgacagttctgatgcctgaagtctgaaatccattccactaagtcaaaatcaaggcgccacaagggttgcattccatccccttccttccggtcaagcacacaagcacacagaggaaaacggcagcacgaggaaaaagagggttaacttgatcagttactctagggtttacgctactaccttagccctcaacctcgaaaacaagaaagaaaaaaaagttcagctcagcttttagaaatatttttttcatacaaattggaatgcaaattaatttttctagagaataagagaatattcaacaccaacgtccttgagggtggagacgatagtttacttatttatagttattccctctctgacccaggccccactatcctctgtacagcctgacacagaaccttcccaacaggagacacccaatgaatgtctctgaatgactctctagggctcagcagtacagctgccatccatctctgtcctccttcagaagatgtccaggatggatgctggggtagggtagggtggatgttgctgaagaaaacctctttttctctttcctaagagaaaacttgctattaattattccatcaaataaatgcctagaaaattgcaagaaaatgtgaagcaaaatataaaaaaatcaaacatcaatggcaaagcagacagaatagaaagggaatatacattgtggccagaaaaatgagaagaatgtggtcctgcaaggtatgtttcattactgtatttgtaaagtaagcatgggttaatcttttacctttttagagtatgactcttcaaatataaaatggtgatggtgataacactaacttatttgttgagatggttaaagaatatacaaataaaagcagtgataaaacaattaagaaccaatatttttaacccccatgctacttagcttgtatttactaaatcaaatttgatagaattaagagaactatgtgtgaaagttctttttacaacattgcaaatgatagctttaattattacttgagataaattacctttgagtcagcatcatacatttccatgttgaggacacaataaaaatttggaaaaatgccttccttcgctttaattcctttctgctaatatatagaacagccttctattcaaggactcccaatttgggcaaaacagtacctattcttgttttctaaagatgttttagaataatatgccttgcagaacagctgtagcctaatggttaagagtttggactctctagggtcaaattgtaactctaccactcatccgctgtgtgatcctgggcaaattccttagcttctttttgctttaagctcctcatctatcaaatggaggtaaaaatattacctcacatgtagttgtgaggattaaataagttaatatatgtaaacagcttacgctagtataccagtgaacactcacttaatgttggctattataattctagtcattataaaacagctatattttattgttgatgaaacttataatagataaatagaagtttacttaaatttaatggatggccctttcttatacaattacgaaacattcatccataacaggtctaggatgcagagagatttctatcttggctcaagtaaagagaaagaaaaaagaaatatttcattttcacaatgtggtagaaactatgaagtaagtgattagtagtttctttgctatctcttttttccctgtcacacaaatcttgacataccattaaaaaatttgagtgaggactcatttcagccaaggtatcagtttgttgataagtggtgctcatggcaaattatttaggagatgaagttctggaagacaatgtcttggaagctgacatgtgaacgtgaaaatctgctacaagcataggactagaatctcaaagcaggcttggggtttcagcattgtgttctttttaggcaagtttcaacaaggcaaagggctgcttaacttctccatgtcaagaaacagctttatcattgtggctgaaagtactcacacacggttgctagtgagcaacctgccacaggcctgatccagagagacccggcattaacatgattctccctagggaggaaatctagcaatgcctgaacagacatggagtcctcatttccacgcccttggtacagactcagaagcagcagggtgaagcaatagcagcagctagaacagagagcaaacgcagcacccgaagtgttcctccaactattatgttggtgccattacttttaatggcaagaacctcaattacttttgcactaatttgatatctagaaatctggttttgcaatgcaatagtggggagatgtcaatgtaaaatatgttctatttccttgtagttggttgatgcttatttatgtcatcatcatcatcatagcatgttacactacatttatctgagtgattttataggattgtcacactattcataaatgaggaatatggagtagaaaatattcccaggcaggctacagttacagaggtcagattgttacaaagttaagaaacatttgcaacatcaatatgtgacatgcttactgaattccctgtcctggtgtcttctttaggtaatgtttcatgtttgagcatctttcttttataactgacctatttctaacttaaaagtatcttctgtattttactgatactcccgaaagaaacatgttcatattagcataattattaccacaaaaccaaagcaaagaataaggatggaactatcttgttcttccactcatacaactttccttatcccactctttcaatatcccacccttgcccctggaccagtagcaagaaaaaactcattagttccactgtggagttggattcatgggaaagtccatacaaccacatctgtttcctacaaaagatggtgaccaattgctcttcatctctgttagggatttaaacaataaattcttaacatattaaagggcatataaggtacaaagagattaataataaaggcactgatatctcattttgtgaatctttttgaaaagaaaatatgggaaatctagggttgatctaccgggctgtgggcagagatatggaatggaataaacaataacttgagctgatttttataaagaagaattttctcattccattgtgttatagagatgttttgatgacatccacgtttctaagaattgtgtgttcctttaaagaagagcaacagaagaaatacatgatcctgtaattgatgtgccacatttcattttcttagagagttaccattcttcccataatactagattggacagttttgggttaatggattttgcagtgtaccattacaatcattcaggtcacttggaaggtttgcaaaaatcacatgtttcaagtgtcctgattaatggaagtaatattctctttttcattccccatcaaatgtaacttacttcaaatttatggtttaataaagcacgtcagactttcctaaattccttttcaatatattacatgatattttctgatactttatcaagtttgtatctgcaagactagaattcacaggcagttatttttcaccaagatgaagatagccttcaggacaccgcttgtccacacctgtaatcccagcactttgggaggccaaggtctgccgatcacctgatgtcaggagttcgagacaagcctggccaatatggtgaaaccttgtctctactaaaaatacaaaaaattagctggtcaggggtggcgtgcgcctgtagtcctagctgttcgggaggctgaggcaggagaattgcttgaacctcggaggcgaaggttgcaataagccgagatcatgccaccgcattccagcctggctgacagagcgagactttgtctcaaaataaaataaaataaaatagtaaaataaaatgaaataaaattatggttcatagcaacgatgtatatcacttcttttaatttttaatagtttccgtattaaaacatccgagtttccccaaaagatcatcattttggctaaaccaaatactttaaaatattaaaagtttatatatgattaatagttaacagcagaacataggataatttttctcttctaaaagagattcatttatatgatttgaatttacttgaaacaaaatataacattttatgttccaaccactaaaaaatgtttttgtatttgtcctcagacgtaatttaggttttaaattttctgttgatctctttttttagaagcagagggaagagtagaccttctcatatgattttcattactgtagtaatatttgcacatacttaatttctattggaaatatttgttgtaaatataatttctatactcagtataggcaaaacaatcaaatttaattaacaaaaagcatttgcacagccagtctggctggaccttatgcaaatgtagaaaatgacaagcttgaaattaatcaccaaatgtctgaaattaaaacagaattgtcaaggcagaaatgtatgaatcataatagtatctaattccatggtttctgggcagatgtctttctgtattctgatgaaaactagcatttatttatattaaaacctcttcaacaaaccatatgttatatttagctcagccaaaattcccaggtggagaatatttgtatggaagatttcaaaaggatgatcaatttagatgtaacctacatcttatttatttatttatttatttttgccttttatatctgaagactgcattgaaaagacagatgcatcttttcttttatacttcaacatccccagtttgatttaataagtcaggaaagcaagcacctgaagattttatgaatcacagttccgatttagaatatccacagaagtgatctgtgtttccctttgtgtgtatccttcaaggatacattggagcaacgggtatccttcaaggatacattggagcaacgggaccagcaaatctcagcagaaacttattgagaacaactaaaaagctgattcaggcacttggtgttgagatgctatcattttctcaagtgttagtaagtaagaactatgtagaggggaaattgataaaacttttgaacatcatcttagcattgtgtaacgaagacagaccaatgtcataactgtgcatttaaaaagtatttaaaattagtactaaatgcaaattgggtaatgtaagacatttcctctattctgtgtttgcctctggcaaactagaattacttcaaaaaatttaaaaatcagggatatgaaatgtcttccaggagacaagcacaaaatacaaaacacaagtaatattaatatttcctttacagtgtttacagaagtctgggtttctctttcctggaaagttcaatcactttatctaatgtctgggttttgggatatttatactcctggccacctcacaccaagtcatctccatctaaatgctgtttatggcttcacgtaaaaggagtgtaacttccaacagtaaaaagccacggggaacatctctacagtcctccaatttgaacactcaaatcagcacagaaaaccaagtaggtatttctccaaattgcccggtgttgagaatcaacagacacacttgttaaaaatacaaatcccggccaggcatggtggctcacgcctgtaatcccagcactttgggaggccgaggcaggtggaccatgaggtcaggagtttgagaccagcctggccaagatggtgaaaccctgtctctactaaaaatacaaaaattagccaggcacggtggtgggcgcctgtaatcccagctactctggaggctgaggcaggagaattgcttgaacccaggaggcagaggttgcagtaagccgaggttgcaccactgcattctagcctgggcaacagagcaagactccctcaccaaaaacaaaacaaaaaacaaacaaacaaaacaaacaaacaaacaaacaaaaacctaggttgacctcaggtaaaagaaatagtactacaaaatctcatgtcaattgtaatccccagtgttgaaggtgcggcctggtgggaggcgactggatcatgtttacaaatgtcttgttgaattttttcattcttcaggcttggggaacactgcatatcaccacctcctcttcccatagaggaaacaacccagcaaacaccaagataaaccaaagaacaatgtcaatcagagatgagtaactaaagacaagttataatcataattaacccaaatttattttccaggtcaacataatatttttatcccttctaagagacggtctgttctaatgggcaacagtcctccacgccgagccactctcatctcctactaacttaactgccctgcactgtccctcgactttcacctttcttgccttaggagccatccatgaaaccctcttctaatcatctcactttctccaataaaaaaagtagtttcatatgtgccgaaaataaaaggaaaaaggaactgataactccttggtatcttttagtaattcttgatcattggctcccaatttctagaattacctaagatttgcatttcttggaaatagagatcacagcctgtgtaacatagaaagaccccatctctacaaaaaaaaaaaaaaaaaaaaaaaaaaaaaaaaagcttgcccctgtagtcccagttacttgggagggtgaggcggacggatcgcttgagcctgggaggttgaggctgcagtgagccatgatcgtgtcactactgcactccagcctgggtaacagagcaagaccctggtctcaaacaaacaaacaaacaaaaaaacccaacatatttttgctatcataatcatattgctgcttttctctcctaccatttaattaatagagtaatataatgttaattagattttttttgttggtgatcacgccaagtatattttaccactatttggcattcttcgtttaaaaggttaatctttaaaactttttttttttttttttttaaagttagcatcttgctctgtcaccaggctgtagtgcagtggtatgatcgtagctcactataacctcaagcaatcctcctacctcagcctcccaaagtgctggggttatatgtgtgagccaccttatctggctcttttaaacttcttaaaagagataaaaaccagacactactttaaaaaattactaagaatagtaaggacctcataagagccaagtttatcttacagcactaaaattatcagattccataagaagcttcagtttacctgcagtctgtatgtccccatctggcattaacctgccaattatacaaaggggctaaccagaacagaactgacctgtaagctgattagtttccaattctgatgaacaaaatcgtgcagttttttggccaaaattcacttcttatggttggttgtacacttgttcacttatttattggtagagcttctaaagattgcataatagattgcaaaatatctattgcccaaatcccaataatagcaatatttacctaattatagaccactagtgagtaggatcatttggggtgagtatggtgataactgatttaataggccttctgttcctggcctaagaaaagtgggtgtctttccatatcatcttagttagcatgcaataaaggtagattaaacaattcttaggatacaaaaatgaagttctcaactatgcccaggggcgcacaatctgataagaaaccatagatatcatcaaataattaagtgttagaatataggtctgtgaaacgtgctggacatattaattctgagtatttgggcattatctccttaggtctctggctaagctcagtgtctgaagtgttctcaatagatgttttttgaaagaaaaataaacaactgattaaacttacatcactagtaatcaaaggagtgaatacattgggacaatttatcctcggaggttgtgggttgataggaaattctgccttgcagaggctaagtttgaagtgtctgtagaacatatatagctggagatagatacatgggtctgaagttcatgtctagaggcaacagtgcctttacctttgctctctaagctggcctcaggataaaaggtgcaaatctgcaggagatgtgacaattttgggatgtcagattgataagacctgagcgagatgctaatgacccttattctttgcctccacatcctggaactagagatttttgttacagaattataggaaagtatattttccagcctactcaaataacttacttcaatgttgaatttccagaagaaaattagagtcaaatgttgcttaaccctactctgaatgcagaaccatgcaaaaagaacatttatgttgtctatgtaactgtttctaaattccactcccggagcttcctgtctttacaagaaattctcaggcaattttcagacaaataaaatggtttgctttaactataataacacatgcataattaacatatcaatctgtatgtggcaaatagtggaataatgatttgcttattatgcaaaacatattttttggaaggatattgtataaatattacttgggtaaatgtaatgagacttagttataaccaaaaattgtattgcgccatcttgcttgcatcatgatcaagctctatgtaaagtagccaatagtaataaatggatacaagaaacagaccagataattatgaaataaagaatatttagctatgaaacataatttcagaggttatacatagtaagataagttgacaaactagaaaccaaatcccatgtgacttaggtgttgtagccaggggtgaatgcctcagttgttacttttagtccatttgtatcagatgtctcaagacacatattatctttaggaagaaaccttggtcaatcacctttatccagatcaagaattgagctgttatatggtccatgaatctgcttatcacctgtaaaatggcttcttccattagatcattgaggtttaatgagaaagtaaaaacttattttttagtttttagagatggggttgctctgttgccctggttggagtacagtggtttggtcataactcactgcagtctggtcttcccaggttccagtgatcctcccacctcaacctcccaagtagctggggccacaggtgcatgctaccatgcccagcgaagtttttctttattttttgtagagacggggtctcactacactgccaggctggtctcaaactcccgggctcaagcaatcttccagccttggcctctcaaagtgctgggattgcaggcatgatccacagcatccagtcctaaaaacttctttttgaattagaaggagactgttgttcatctcgactatcccatgttcatttgaacagattattagaaaaacaaattaaatgtagaattgtgaattacataatgcaaagagcatataaaaacattttttcagccatttttaaaaaatgtgtttttgaagaaatgtaattgctcatatttaagatgaagaattaaaacactaatctaagccatcagagctcattcttgacatttgaaagcaatgaaattcaaattttgccttttatccttatcttgtaccatattgattctaaattacttagagtttttcacagcatgatcaagaatgaagcttgcagtttgccaaatcttttttggtcagaagtggcattttcttgacaaggcctgtcactcactcagtgcctactcactcatccagtgtaataatttaaacaagacttaaggagggtttttggtaatttttttctttgacaaacaaatcctacaatgtcgatagactgagagaatctgaaaactgtgacctgaccaacttgtgcctgcactagatcaatctttcaccatacctggggagggtatggggacaattctgactataagtgccagccattatgaaaagtctgaatgttagttgccaaggcaaaagcagtagaaaaaggctgctttgggatgaaaaagaaaagctgacttttgtcactatctctaagacaacaatttctcagtataatacattatcaactgaggactacttgtatgtatagttctttcaaatatttctatcttttgcaagtcattagttcacatgtaacccttattctcacttcagaattaaaaatttgaggctgggcacagtggtgcacacctgtaatcctggcactttgggaggccgagggaggcagatcgcttgaggtcagcagttcgagaccaggcagggcaacatggtgaaaccccatctctactaaaaacacaaaaattagctgggtgtggtggcacatctctgtagttccagctagtcgggaggctgtggcaggagaattgcttgaacccaagaggcagaagttgcagtgagccaagatcacgccactgcactccagccttggcagcacagcaagactctgtctcaaaaaaaaaaaaaaaaaaattatatgcctggtcgtagaacttcccgccacacagatgtcagccatagcctgggttatatttggctctgtgactgcattcatgggagctgccctcctgccaacttagccctgccccagtagctgagccagtcctgtctgaggggcttcccgtctcctcctcccatgcagccgaggcactcatgctggccgtcacactggagcctctgtgctccttaactgcttgcccaagtccagcctgccaccatatccctgttctaaaaattatactctgaacctgacttccctctgggctctaatttataagtctgggattttgcctcagtttccttagggaattccttttctggtaaactgctaagcattccagctccctcctgggactgggccatctgccttagtccttgctcttgtcagttcctgtctccagcatgccacccaaggacagactcctcagatgtggactgcctggtggactgcttaccccattgtaatcatgcgcttagactaggtttttactttacccttgactatcatcataattgcctctgggattttccacccttccatctttccatccatccatccatccgctcacctacccaaacacctacctactcatttatccatctgtctattcacgtatctacctatgtatccatccaacggtccatccatccatccatccatccatccatccatccatccatccatactttaattcatttattctttctctcatttattaggaacttactctttgccagcctctgtgcttagtggtagagaaacaatggtttctaagacagatatcattcctcctctagcaagggagacagaagttaaagaaacatttacaacaaagtgtgataagtcgctgtctcatgcattggcctaagtgggtgggtgcaatgccaagttcctatacttctgtcttgccctgtttctctaagtgcacacagctttactctgtggaggcaaaacagactagtattttcagttctctttttgagaactttaggagaaaaaaaatgctatcattccaagtcaggagagcaagcattaacattatacacatatttacgtaataatcccctagacttgtatggggttttgaaatatgcaaatacttttatttacagatattatttgttcttcagagcatacctgtgaggtatatgcaggataggtattattttcatcctcacttcatggaacaaaaactaaggttcataaaagttaaaatagttttaccaaagcctagagctgaaactaaaattaagctttattattgtcaatataggcttctatccacgttattaatactcaatggaaacttgcacagtttccaaaatcttaggaacgtcagttccagttattgccatctatatttttaaacaggttaatgctcacaggatagccttttatgtcacttgttttataaaaagacaaaagataacacacagaactctaaagtattgatttatattccattaactgtttattactttaatctatgaatccaagtggggaggtagaaagatgaaatcacttgcctcttatctttgaaagatgtgagctcattattaaaccctgacaaaaacagcaggtagctcaggaaacattttccaaagaacacttagagattttgattcatgactgaagttctactgtggcattttcctctccatcacccttcatggggaagcctcatcctattatcatctgttgtcatatttaactagggtcatcagaatgtgttgttatatgtcacttgtttcttcttcctttttctttatatagcactatgacttttattttcccaaacagtttgtgtgtttgaaactgcagttgtttcttttgggggcagcctccttaagtccaccatggtggttagttttaagatattaataaacaaggcaaaattcaaatgtgtatcacactcctggatcttagttaccctatttttctatttaccttgtgatatggcttggctctgtgtccccacctgtattatctgttctcctgctgctaataaagacatactcaagactgggtaatttagaaaggaaagaggcttaattgactcatagttcagcatggctggggaggtcacagggaacttacaattgtggcagaaggggaagcaagcatgtctttcttcacatggcagcagcaagaagaaatgcaaagtgaagtggggggaaagccccttataaaaccataagatcttgtgagaactcactcactatcacaagaacagcatggagggtaaccacccccatgattaaattacttcccactgggtccctcccacaatgtggggattatggaaactacaattcaagatgagatttgggtggagacacagtaaaaccatatcattctgccgctggcccctcccaaatctcatgtcctcatatttcaaacacaatgatgcccttccaacagtccctcaaggtctcaactcattctagcataaactcaaaagtccaagtccaaagtctcatctagacaatgcaagtcccttctgcccatgagactgtaaaatcaaaagcaagttagttacttcctagatacaagtggggtacagacattgggtaaatacacccattccaaataagagaaattggccaaaacagaggggctataggcaccatgcgagtctgaaatccaataggtcagtcattaaaccttaaagttccaaaatgatcttctttgactccatgtctcacatccaggtcacggtgatgaaagagtgggctcccatggccttgggcagctctgcccctgtggctttgcagggtacagctcccatcctggctgctttcatgggctggcattgagtgtctgcagctcttccaggcatacaattcaagctgttggtggatccaccatttgggagtctggaggatggtggccttcttctcacagctccactaggcagtgtcccactggtgactctgtggggactctaaccccacatttcccttctacattgccctagcaaagattctcctgagggatctgcccctgcagtaaacttctgcttggatatccaggcatttccatatgtcctttgaaatctaggtggagattcccaaacttcaagttttgtcttctgcgcacccacaggaccaacactatgtggatgttgccaaggctggggggcttgcaccctctgaaacaatgtcttgagctgtaacttggccccttatagccatggctggagtggctgggacacagtcccgaggctgggcacagcatggggggccctggacccagcctgcaaaaccatttttctctcctagtcctccaggcctgtgacgggagggactgctgtgaaggtctctgacatgccctggagacattttccccattgtttggtgattaacatttgactcctcattacttatgtgaatttctgcagctggcttgaatttctccctagtaaatgggtttttattttctattgcatcatcaggctgcaaattttccaaacttttatgctctgcttcttcttgaaggctttgccacttagaagtttctttccccagatatcccatatcatctctctaaaattcaaagtttcacttatctatagggtggaggcaaaaagccaccagtctctttgctaaagcattgctggaatcaccactgctccagttcctcatctccatctgagaccacctcagtctggacttcactgtccatatcgctatcagcattttggtcaaagccattcaataagtctctagggagttccaaactttcccacattttcctgtcttctgagtcctctaaactgtttcaacctctgcctgttacccagttccaaagtcgcttccacattttcaagtatctttacagcaacgccctactgtctgcagtaccaatttactatattaatctgttctcacactgctaataaaggcatacctgagactggttaatttatattggaaaaaggtttaattgactcacagtttagcatggctggtgaggcctcaggaaacttataatcatggtagatggggaagaaaacatgtccttcttcacatagcagcagcaaggagaagtgcagagtgaagggggccaaagtcccttatataaccatcaggtcttgtgagaactcactcactatcacaagaacagattggaaggtaactgcccccatgatgcaattacctcccactgagtccctcccatgacatgtgaagattatgggaactgcaattcaagagaagatttgggtggggacacagccaaagagtatcactatatgaaactcatgttgaattagagttctcatgagatctggttgtttggaagtacatagcacctccccctttgctctatctttcctgcttcgctatgtgaagaggtgcctgcttccccttcacctttcaccatgattgaaaatttcctgagatcttcccagccacgtttcctgtacagcctgcagaaccgtgagccaattaaacctcttatctttataaattacccaggtagtttataaactactcaggtagttctttataccaatgtgagaatggactaatacaccttgtttctggaattatgggtaaaatccagtatttggtatcatataattaaaagtatttaaaatatgaaatttctcatttttaaaatgtggattctgttcatgcagataaaccttaacagttattttatagtttcttgaatacttgaagcaagggtattccagaaatctaaaaactggtcttataactctttaattctattaagcagagagcaacctgacaatcatgaggggtgaggtcaaagggcagtgtgactgccacctgatacttctgtgccatttgctgtcaggtgactttgtcactagttttgtagaatggagaactttctctcatgattctcactcgctccctgatcttttaggtctgaatatgtattctctgaagctttattggtggtagcattatgaacttgtcaccatgggagccccatgagggatagatagtatatcggcagggaggaaaaacacccccaaatctcctatgatgtgggctcttttagaattgattttttttctcaataattttaatgaaatccttctcagcatggcaaagtaaaccattagtctgttttgaaaagtgcatatttcttccaagttgaaaagaatcattgttctgcatggataagatcacagttcatttaatagctccatataaatagttctagaaaatccacaagtataaatcataactacacaacagtacacatagacagacaacagggatgtgccattcctttaggaagagcaggacacgttggtgtaagtattaaggtgaatttagtgaatggaaaattccctgtaactttatcaactcttttcaattggagtttttctcagaaattatactgaaggtacaagacccaaacacaccaagatgacaatgctacaggtgctaatctaaattgagattgttcatatttggtaacatttaaaggtggttaagtttttagccacaatatcaaacctttcatagcattctttctttaattacatattactcactgaaaataacattttcttcagtgtatacttgagcactggctttagaaaatgcatgctcctagaatgattaagagaaaattccctttttatatttaggaggcaagcaccaaaactttgaatcaagttgagatcaaattttatgatttagatcatctttattaagtatttaaactgaggtattattttgcgtgctttgggagcagaaagttgatggtatgttttccgttctcaaggagatttttagtcaaggaaaatataggtccgcacatactgtgataaataattccaaatacaagtttggttcctgctcatgtgacatgagcagtgaggttggcacagggatctggtcactgtggtcactgagggacacaggctggcaagggtttcatctggacatgcatttccaagttcaccacagcggttgagagagactggggactctgtgggctctcctgatgtatctttttcatttgtttaacttttaaattttaggttcaggagtacatgtgctggtttgccatataggtaaattgcacaccgtgagagtttggtgtacagattatttcatcatccagatgataagcacagaacctgataggtagttttttatcctcactgtcctcccatgctccaccctcaagtgggccccggtgtcgtctgttgttctcttctttgcgtccatgtgtactcaatgttttagctcccactcttaagtgagaacatgcagtatttgttttttttgttgttgttcctgcattagtttgcttatggaaatggcctccagctacatccatcttgagacttctgcttacattttattggccagtgcaagtcccagggtcacgactaactgtaaataaggcagggaagtgtaattctgtggtgtaccctgggagcgacctggcactgtttggtgaactgtactaatgctgccacagaatggtgagatgtgtgtgggccacccccatgtccctgtgccatcagaggtgtgagttaagtgggctgctataaaaatttaggaaaaatatattagaaaattccagattgcttagaattatactgtcataagtaagaaaggtgagatgtgcaggtggatgtgtcatcttcactccactgttgccacggctgattctctcaatgttaataaaagaaaacgactctcacagaggaggtgtatacttttacaaaggatgtatatatgcggggaaggggaaaaatagagggttgatcatcttccctttaaagatagatacatattcatgtggtatataaattcagggctgtcatgaagcaaacactgatgatgaggtgagagaggcaggttatctatggggaagggggcaggagaaggccgtggagccttcagaccaaagctcaggtctgatcctgtcatgaaagaaagggggaaggaatgaggatcctcgtactgcaaggtgtttctaagaaaggtttgggcaggctgatgggtggcctgcaagccaaagtcactcctaagagcgctagcactgtttgctagctgtgcctgtcttcatacttctgatgtgcttagtcactggccagaagcggcctggggaaaacacaaaacttgacataaatgtggtagattcagaatggccagaaactagccctcagacagttatgatcccacagcatgagatctgggtggtacatttttatggctacaacacatggtttttagatcctgtcaattctgtattagcattggtcttccttggatagtacaattccaaaggaagctaacaagtggtgaactaataagcaaacaacctcaaaagtcaaggactgttacttcatcactgaaaccaaagtaagtcctgtcctctcaggctgtggtctgaggtcttatatagtctggagaattccaaagaggttaagaccctaggagccacctaggaattgagacatacactaaaaaatacctgggggactgatttggtttcagatattcagactgaccccaggaaagtacctctaatgaatctacagagcccttttattttcaaaggattttctagatgaatctaagaccaatgcactttagcatctttctaatccacaagcacatccggatgataactagactcattgtgggataaatttggtagcagactggagaagataactaggagctttctttttttctcatttgcatttattagcaactgaccatacatacacacacacacacacacacacacacacacacacacacacacacacacacacacacattacagcaggtagttagacagacatgagcagggcaggagaggggctcctgccaccagcaatgtcaggtgaccatcaggtgatggtctgatggttaggcagtttttaaactgtctctgaaataataattgatggcagccagcaccagggaaaggcagtctcccaatagacagaaaactcctgaaactggtgatcagcaacttctcgataagatctcaggagttgaagtacacccaagcatgcattaagaggcaaaatggcaggctttaactggtatatgaccttgtaggaacactttattggtaagggaaaaacacctcaagtgagcatgtgtacaactccagtaaacacactgtgtgtgcagcccctcccaagtgctggaaggccactgcgcatgtggacagcccaccctaacggaagaatcaggggagaaggatcgcaatcccccagaagcctgccaatgtataagactccaagtcaaaggtcaaaccatgcacgtgaatctctcaagttgcctgcttggccctcttccaagtgtactttacttcctttctttcttgctgtaaaactttttaataaactttcattcctgctctaaaatttgtcttggtctctctctttctctctctgctttatgctccttagtcaaattctttattcggaggaggcaagaatcaagtatgcttcagacctgtatggattcgccgctgctatcatactttggcactgtgacttggatatgtcacccagtgttaagacacctctatgacttgccttccttagctggatgtgttcaacccctgtacatgattttctcctcccctttcactattgtgcttactaaccaactagtagggatgattcctctcagccatagaggctctgctcctcctggctgatctctcggttcactctgatgggtggcttgtggaggaaggaagaaccctggagtctgcactaagtagacctgaggcacttatggccctctgggacaggaggcttatgagagtagtagggttaaagcctgagaccatgcaatgcctggggtttcctctgctttttcaactaaaatcagctctttcccaaaaacccacacagcctattctcctgttttctctgtgtatatttgaaatggccttgcacacctgccagacagtccacattgggaacaaatctgtctcttctctgttttaatttcacatgtaaagacacactccctgttatttgtgtgcccggggctcttgttgcatttgtgtagcagcaaagaaatagactccctttcatatgtctgttggctcattgccaggacagacactaattggaaccctaactctgccagctccttatgatttaccatatactttttgttcctgctatgccccagggccaagtttttcagtggcttttgaagcagtttttctgcctgcacagggccttactctgtagccttttaagggccctgcctacttgctttttttgaattagcacccctttgggaggagggaaaattctttctttaccatttatgagcacttaccccaatcctcaagtcctccagaagttccttctttatgtcaagagggcaaatgaacattcctctcttgaatccaacatataaaggctttccatgagtattcctcttgttttctcccacttcctcctgtagcctccgtttctctaataatgtccatgcccttttcaatatgccttgagaccttcaaggtcttattcaaagggagaggagtctagattcttgcagcagctagctgcaaaacaggcctcctgtctacttaaagaacatgggaaattgggaatctgagaaaagagacaatcattttgttgctaaaatgctctgagtgagagtcaccataaggtcatggagacaaggacataggctggcccaaggccaaaggctcaagagacccacaggacagagatgaaggctagtctgaggctaacagattaccatgagaacagagatgcaggcagggttaggggtacacaggtaagggcagtggtaagaccagtacatttcaaaaccccaaggatgaatagggggccctctgtgtgctccattgcctcctctgtaattgtggcaagatgggaccaagggtccatggtaagactggttcattccagaatcctaaagatgaatgggggctgccctgttcaggatagggaaataagagggctgcccttgttccttttccttttttttctccccttttctttctttgcacatgggtaactgtgtctccatactcaggacactccccttggatgcatccccaagaattgggaaaagtttgatttccccaaaccttaaaacaaaaaaaaactagctttcttttgtaacactgtttggcctaaaaataaactagaaggcatgagccgccgcacctggcactttgggaggccaagacaggtggatcacctgaggtcaggagtttgaggccaacctaaccaacatggagaaaccctgtctctactaaaaatacaaaattagctgggtgtggtggtgcatgcctgtaatcccagctactcgggaggctgaggcaggagaatcacttgaacctggaaggtggaggttatggtgagccaagatcgtgccattgtactccagcctggacaacaggagcaaaactccatctcaaaaataaataaataaataaataaataaacagactggaagaaaattacaaaaatcagccttagaactcgtgcccttagacaggaaatcctcaaattagcttcttcagtcttttataactgagattagaacaaggaggacagggctaaggagaaagagaaatgcaagatgcagaggcaggctcaactactggctgctttagaagttgtccggccccctccaggatgccctcagaataccctcccaggtaatggccactggtgctagaagccaggccactggaaggcaaactgccccaatggaattagtgggaaaaagccccgcacaacttgctccctctgttacaagctctgccactggaaacagtacttcccttaaggccaaagggtctccaggacagaatcccaatccttgatgtccttaagatgaagggtctctctgctctagctggcttccaaatcagacattgtcattaatgggataaagccaagggcaactctggagttgggaagtaaaatgataaatttctctcttgagttcaagggctgcctactctgtgctagtctcctctgagcaactctcctccaaatcctgttgggtaatggggcaaatggcaccccctccctctaaaagaaaaggttaacactgctttagggtaaaaatatacttcccaagatgggtacctgcttaatatttaccaacctctgaattcatctttctctctgatagccctatttctcctggaaagatacctaaatcttcaacctgcaactttaacctcgacagtcctgcctcggaggtttaaaaatagcccacaattattcagacaagctctagtgaaaatcaaactgagcaatatcttgaggaagaatagcttctacagtatgtacataacttcctcattttgctcccccttcacagaacttgcacaacaacttgcagtacaaacaacttcctcacagaaggaaaatgacttatctcattcaaaagttatcaaggtaaataagtatttctcgtaaggaagattataaataaaaatattttctatgataaaggatcttgtatggtaaattcttgtcctaaagcaaaatgactggttatttgaaaaagaaagatgttttggagaagtcagaaagtccaagcatgttgtatatgatctatgtaagtcatgagaaaattcatgaaaggaaatttatgaaagaaatgtggtaaaatttaaaggttattaggcctactaaatgcatcatgaagtgctactacgactcttaactgtacaacttgccttctttaaacctcggtaaggcctggggacatataaagctagccatgccctctagctatgctggacagagtcagaccttatcttcacttctatctggtgtcctagtcttcacacctaatacataattagaattgcctacttaccaagttttcaccaaaagtaaaagttgccaagagttaacagtgtaacatgtacttgagactactggaaaaataattttacatgcagggcatgtaaggaaattagaatgtgctttttgtaaaagattataagaatacatgggaatgtgaatttttttgcctagtttagagggttaaaggattgttttaagttagataggataaagctgaaggtttgaggaagttgtggaaggtttgtgaaagattaatcttataaaaatctgtgtgtgaacatattagctaaatttaaaggggtattattcagtttacccataaattgaacattggaataaaagtacaacattttttttgagatcactgttctgctctttaacagaaaattgtaaaagattataaaaggtttataaaaatcttatcttatggtcaaactgactaagattagatacatttgtctataaggttttactaagaattgggtttaacatccatggtgctttcatgcaaaggtacaatttggatttctttggatggtatttgtataagtgtgttactggtatgtattccaaaattatgcaaaacttctataattctgatatgacttagtatatgttatcagtaataattataattgttacagtaaattatgtgtgccacagaggtaacaaattttctatcagctgtgtctttgactgtggcttccctaggactttttgtcatccacagacagtttttgtcttgttttaatcctcttgaaaagatggttttataatcacctataggactgtaacaggtgctcttaaatgcaggatgctgataactttagagattgtgacattaaaatggagaggaaagaacttctatcactcttttggaaaactaatgtgttcataaatatcaagcaaaacaagaattaagtagccaaagtaatccttgtgtgactttttgtttaaaatattgctgatcctttgtttttcagaaagtgtattcttctaaacaaaatttggagcatatttctttctacctgagtactccaaaatttggaaactatttgtgagtattcttaacttacggcaatatagtgatttgcctaagcgcagtaagaatctgttttctttcacaacaggacacaattggagaaactggttattttaccagggctttaactggaatggcatgctttcctttaagcaatcaaatttgacttatcaagccaataaaagccccttgggaaaactggcctcatacctcatctacacagtccgtgtacagggtacctgatttgtggtaagtaaagaatgtcactttctgacaggcccaggagctccaagttatcttgggaccttgaggagagaagcttacccaactcatacatgtatttgatggcacaaacctatggctgggcttaaggctttaaaagttattatctgagatttcttatggaatgaagttccatcaaagccaatttaaaaagaaacttatatggcaaataattatttttgccgtgcttcatgcaaataatcaggccaagtgtaataagactaaagtttattttgcaaacaaatcagtctcattatgatttgtttttaataaaaatgagaatgggagagaaaaattatgtttcaagaactatagtatacctgttattagattctagtcccatcaattgttttaactttcttttttttccctgcaatttagactgaccctgtttcttactgtgaaccaaccagtgatcactggctacagcttagaagaaacaagagggatgggccatcaagctccatataatccttagtgagggataccattctctcaatattaaagatttcattgcttctaacatatacacacacaaaaatacattatatatattcctttgaaaacatcatccaggtgtattaatgctttttttatgtttagacaaataaattggctaaaaacattaatggaaaatttgggactcagagcctatactttataaaaaagcttggtatccaaaaggagagtttttcttggtaacagatacagagtagaacttctctaatgagaggcgataaatggctagcatatataatacagtaaagtcactgaagcaatgttacacatattctcctatcaatatattcaatattggagtttactacaatctatgaagggttttgtttccattgctatccaggaataactacattttgagctcaaaagtctgcagataagcttggctaaggcaatgaagctagcaggaaagtctcttatttatctgactatataagatacagaagagaggatcttttattctgaaggaaattaaaatattttaccccaaaatatattttttgacatattttgaaacagctattggttggccaccctgacagaagtggccttacaaggctgtcttaagtggggcaaatttgcatttttagagaatctccattaatgcagtcataccccctctaccttccatgcctttcctcagatctaggagagataaagagttttatacctataaaaatctgaaaagaaacatttactatctattctcactaagggagccttcatctacataacaaggccaccttgctacccaagcttcttccttcctttctctcttaacctgttgccactaaagctgatttacctgtttctggccaggctctgaggctgcattctttacatggtctcagggtggtttctgtaactcattaggtagttgggtcttcattctgaaggctcccatgtatgcatattaaataaatttgtagcccatttttctattaatcaatccacctcatgtcagcaatttttagtgaatctttaaggggctgagagcctatggcccccacaattcattctcaaatccaagtgtttcctaatgtagtttcacccacctggcatgtcctcctggatctaaaacttactcagtcttttagcatctggcatcatcagtcaaaagctttgttgtcattgatctgatattctagagaaatcatctgtaccatataatctactacttaggttttgtctttttttttccactaatgaattctcatttaaattagaaggacagtatctcatatatcttttacaccctccaatcagttcttatcacaaaactatatatatatgtagatcaaaaataaaattctaagcccctcaaccaactgaagggacccctcttctcagccaaggacattccaaagttaatttgaaaaactagttcagtgaaagagatagagacacatgaaaaaccattcaaaagatcaatgaatccacgagatttttcttgaaaaaattaatacaatagactgctagcgagaccaacaaagaaaaaaagagagatgattcaaatgaacacaatcagaaatgataagggggacatcaccactgaccccacagaaatagaaacagccatcagagactattatgaacacctttatgcacataacttagaaaatctagaagaaatggataaattcatggacacagacaccctccctagactgaaccaggaagaaaccgaatccctgaacagactcataatcagttctgactgaagtagtaataaatagcctaccaataaaaaaaagcccaggactggatggattcacagatgaattctaacagatgtacaaagaagagccagtatattcctactaaaactgttccaaaaaattaataaggagggatcctccctgaagtaggcatcaccctgataccaaaacctggcaaagatacaacaaaaaaagaaaacttcaggaaaatatccttgaagaacattgatgcaaaaatcctcaacaaaatactgaaaaatcaaatctagaagcacatcaaaaaggttatccaccacaatcaagtaggcttcatccccatgatgcaaggctggcttaacatatgcaaatcaataaatgtggttcatcatataaacagaactaaagacaaaaaccacatgattatctcaatagatgcagaaacgtcttttgataaaattcaacatccattcatgttaaaaaaaatctcaataaactaggtactgaaggaatacctcaacataataagcaacatatataataaactcatagttaacattatactgaatgggcaaaatctagaagcatttcccttgaaaaccggcacaagacaaggatgccctctctcatcactcctattcaacgtagtgttctggccagggaaatcaggcaagagagagaaataaagggcatttaaatagtaagagaagaagtcaaactatccctgcttgcagatgacatgatcctatttctagaaaaccccatagtctcagcccaaaagcctcttaagctgctaaacaacttcagcaaaatttcaggatacaaaattaatgtgcaaaaatcactagcatttctatacaccaacaacagccaagctgagagccaaatcaggaatgaattcccattcacagtagccacaaaaaaataaaatacttgggaatacagctaactagggaggtgaaagatttatataagcaaaactacaaagcactgctcaaataaatcagagatgacacaaacaaatgaaaaaacattccatgctcatggataggaaaaatcaatgtcattaaaatggtcatactctccaaagcaatttataaattcaatgctatccccattaaactaccactgacattctttgcagaactagaaaaaaaaattaaattcacatggaacaaaaaaagggcttgaacagccagccaatcctaagcaaaaagaacaaagctgaaggcatcaagctccccaacttcaaactatactacaaagctacagtaatcaaaacagcatggtgctagtacaaaacagacacatagaccaagggaacagcatagagaagtcagaaatatgaccacacacctacaagtatctgatcttctacaaacctgataaaaacaggcaatggggaaaggatactcttaaatggtgttgggataactggctagccatatgcagaagactaaaactgaacctcttccttacactatacacaaaaatcaactcaagatggattaaggatttaaatgtaaaatccaagatcataaaaaccctggaagacaacctaggcaataccattcaggacataggcacagtcaaagatttcatgatgaagatgccaaaagcaattgcaacaaaagcaaaagtagacaaatatgttctaattaaactagagagcttctgtacagcaaaaaaataaaaatgaaaaaataaaactatcaacagagtaaacagacaacctacaaaatagggaaaagtttcgcaatctatgcatctgacaaggtctaatatccagcatctacaaagaacttaaacaaatttacaagaaaaaaacaaccccattaaaaagtgggcaaaagacatgattagacacttttcaaaagaagacatatatggagccaacaagcatatgaaaaatacctcaacattactgattattagagaaatgtgaatcaaatcagaaccgtgagataccatctcacaccagtcaggatggttattattaaaaagtcaaaaaataacagatgctggcaagattgtggagaaaaaggaagacttttacactgttgggggggtgtaaattaatgtagccattgtggaggacagtgtggtaattcctcaatgacctaaggacagaaatgccattcaaccaagcaattccattactgggtatatacttaaaggaatataaatcattctaccagaaaaacacatgcatgtgaatgttcattgcagcactattcacaatagcaaagacatgcaatcaatctaaatgctcatcaatgatagactggataaagaaaatgtggtacatatacaccatggaatactatgcagccatacaaaagaatgagatcatgtcctttgcagggacgtggacggagcagggtgccattatccttagcaaattaacataggaagagaaaaccaaataccacatgctctcacttataagtgggagctaaatgatgagaacacatggacacatagtggggaacaacagacactgggccttacctgaaggtggaggttgggaggaggaagaggatcaagaaaaacaactaatgtgtacggggcttaatacctgagtgatgaaataatccatacaacagacacccatgacacaaatttacctgtgtaacaaatgggcacttgtacccctgaacttaaataaaagtaaaaaagaaagaaaggaagggaggaaaggagggagggaggaaggaaggaaggaaggaaggaaaagtagttaaagccacaatgggaagtgggagttaggggttggacatacctcattatatacttctccctttggaattcaggcacagttgaccagcgttaacattaaaacagacatcttgagactgccaaagcagactctttgtagcaataagatactaacataacccaggagagaattaactgagagtttggcattttttttttttaagtctgataagaaacttttatgacctattctctctgaaacctgctacctggaggcttcacctgcataacacaaccccttatcttaacccagacactctcttctattgattccaggtctttagataatattaataacttaaccccttcaagcaattgccaattagaaaatctttgaatccacttatgacctagaacctcctcccttcacttctagttgtcccccctttcctgaccgaatcaatgtacaccttacatgtattgacttatgtcttactacaacatataaaaccaaactgtagaccaaccaccttggttgtatggtcttaggacctcttgagactgtgccttgggccctggtcactcatatttggccagaatcaacctcaaatattttacagagtttgactgtttccattgacacacatagtgtacataatatgtattacacttatatatataaaatgatcaaagcacaccctccttctcatttagacatattccttttctctgttttgtttctcctttgcatttattaccatatggcatactatatacacactaatcttctctctttttattcaatcattgcctcctcaatgcaatatgggcttgatgaggggaggattagttctttactactgtatctctaggcttgtaatagtgacttactcagtagttgctcaataaatattgaatgaatgaataaataatacactttgtgttttggcataaattttaaactatattataatgttacatatgtttatgtacgtaggcatatttatgcatattatatataatgatatatactatatattaatgtcatatatttttccatatatttacatttggaaaccataactttagtcttctgattttgtgatatttaatataccaacaatatcatgaactgatttagatgtttagattatttttggatattaataaacatgatgcataactatgcatttttaacgcataaaatatgctttatagtatacattattgtataaaaatgtttttacatttgtagtgactatgtaatacctaataaataatagaaatgaagagaaatcattatttttggaatcatagggacctgaagagaagcagctaggttagccggttcttgctctgtactgccatctgctgtgtgttggtaaaactacagtgaacatgtcaaatgtgtaaaagccaggaactggggagcaccttagaaaacatccaatccgatgtccacgcgtacaggtgaggaaacagagacaacagaaattaagtgacttgcaggcttgttgtctctctgattattagtagagcttaatgtggaagaagtgctgcttagtggcaaggctaggagttctggagtcagataggcttactttagtattttgctacatggccttcattgagttacttagccttctcagtttcaatgtccttttggggttagagctatttacattttatgattgctctgagagtatatagatagatattacctggcatgcagcacaatcatgactgtgcttaagaaatggtaattatttttatcctactaaagtgtaagttcttccacagcaaaggcattttttccttgaaattctcagtgatataaagtattcaaagcacttggttcatagtcagtacttaataagtatttcttgattaagtgaatgagagtaaggatgagaattggggtccctcacatatcattgtaaattacattgaaaatcatgccttggggattgatgattctttgttgtaaagtgcaagtcatactgactgatacggtttggatgtgtcgtcacaaaatctcatgtcaaattgtaatccccgatgttgaaggtggggcctggtgggaggtgattagatcatggaggcaggtttctaatgaatggtttggcaccatcccccttggtattgtcctcgagacagtggatgacttttcgtgaaatctgcgttttaaaagtgtgtggcacctcccccatgctctcgcttgctcttgctctggccatgtgacatgcccactgcctcttcaccttctgccatgattgtaagtttcctgaggcttccccagaagctgagcagatgccagcatcacgcttcccataccgtttgcagaacgtgagccaattaaacctctttttaaaataaattacccagtctcaggtatttcttcacagcaatgtgacaacggactaatacactggccaatttatctcttcatttgtttctcatgaggtgccctaatctgtgactatgttagcatgtttaatgcaaatcaaaatttctagttctcacattttagaatagttatcttcactacttttaattcaaactgagacaacagacaaaggcttaatccatattttctttttctttctttcttttttttttttgagacagggtcttgctctgtcgtctaggctggagtgcagtggtatgatctcatctcactgaaacctccacctcctgggttcaagcaattctcttgccttggcctcctgcgtagcagggattacaggtacctgccattacgcctggctaatttttgtatttttagtagagatagggtttcatcatgttggctacgttggtcctgaactcttgacctcaggtcatctgcccacctcagcctcccaaagtgctgggattacaagcatgagtcaccgcatctggcctaattctgcattttctacccaacttttttcacaacagctaaatactagagttttttggtacctccacagaaatcttttttttatgattaatcaacctctggattcagagtccagagtgctcactattacaccacggaaactcacactgattaatcaacatctgaaaagagaatatcggttttggaaaattcaagtaaaaagaagttatataaaagttacttataaaagtatattttttttgcataaggttttcccatatatgataactataaaacagttcttcattttccaagatctatgctaagagaaacagcagtcagaaaagcaactctctttattttattaattaattatgtattaatataagataaaatagaattcatggcaaggagccttaaacagggctaaaagaagcatttccatatggataaaaaggttggatccacaaagatataataatcataaacgtaaacaagaaagagctctttaattatatgaagtaaaaacaatacgtataagaagttaaaagtcgtgttgagagaatttaatacatgcctctcagaaatctatcatattctattaaaaaataaaaaagtgagtattaattcattatttctcagattttagtggacataagaatcatcagaaactggccccatctcaaaagctggtgctgtcttaaggcaacctttattttcatctctactcaactgagatttgcttctttggagcccctagtaacttatgagaaatgtgatttttcaatcagagataatctaagcaaatgtaggagacagagtaaataattatttttgtctattcaagatatttacatgttcactattatatataattctataactatgaaataaatatttgacttatttccttagaattgatttttagaaatgggaaaatataaatttaaaagctaaaactttatataaagatatacatgtgtgtgtgtgtgtgtattcaaatatttaactaaaatatttattgaaaaacccaaattattgagaaatctgtggtctggattggaatctttctttgggaaaattaaatattaatataaccaacttttcataggaaataataatatgcacatcaaaatgataaatgtaattatcttaagttctgctcggtgatcgatttgctattcaaaatgctttataatttcctttaatgatttcaagcacaactaaccaaatctccgacttcccagggcagtgccctctcccacagttcccaagaaacatttgtcagcgtcgtctcaggaaaactacacagccatcaccgcattctaaggtagaattacctctaataatagtcccattatattagtgcttactctttcacaatgtacgataatgacactattctgaaatcccttactgcaagaaaagtttgtctctgacattgtaataggtccaaaaggatgggtctggttgtctgaattgtctcgaaggagaggtggaagagacaatgagagccttcttacttgcagcctgtcattatgattttctaactctgttcaaatacccattcatcattacagagagaatttcaactttgttaattcaaagttcccattgttcctaagtatattgcagccccctcagagctgtacttcaagagaggagtttcagttagacttatggtcactttccccactgaaaagtacttttaaaatacagaatataatgaatgtgctcatatatgtgtgtctaaattttaattatctcttggttcctgtggctgccttgtagaggctgaggacatatgctgtgtgtgtctgtgttggaggccgcagtactgctaatggtgaatattaaacaggtagcatcggttctgtgtagatgttaagcagtataaagcaaaaacttggagtctatgtttttctgaagactttctcttagaagaattactttaaggagcccagataatttaggggcacaaaaaaagaccttcgctgcatttttagttgaaatctgacttcactggtaatgatgaaacttttttttttttcatagattgagattggcttctcttagatgtgatgtgtcctaaatagtcaatgtatcagtcctattagaaatcagtctttcatcttcattttcatcagcatcatcattttcattatcatcatcatcatcatgatcaacatcatcatcattttcaacatcattatcttttttttttttttgagacggagtcatctctgttgcccaggctggagtgcagtggtgcaatcttggctcactgcaacctccacctccgggtttcaagtgattcttctgcctcagcctccagagtagctggaattatggctgcatgccactgcacgcagctaatttttgtatttttagtagagccagggttttgccatgttggccacgctggtcttgaactcctgacctcaagtgatccacccacctcggcctcccaaagtgctgggattacaggtgtgagccaccaagccagaccttcattatcttttgtaaccacttttaatgttatgagttatagataagtattaactcaactatctcaacagcctcatgaagaaggtattattattacaccttgatttgacagataaagagacaaaggcaagataatttaagtaagttgcatagggtcccggagttagtaatgttggagtaagaacgtggacttcagagtaagtctacttggatttagaatctggactccccattacaaacagtgtgactgcatgcaagctcatcttccctgactcttagtttcctcaactgaaacagtggcacataatcatggacacacaccaaggagattaagatgggatgggaaagaggagaagtataaactgtggaaagaaaagagcttagaaaaacgggatgacatcagcctgcttactaggcttcctcccttacatctgtgctgttacctgtagaagtctgagtaaccaggctcttaactcataaccaattttttgaaaaagagcagggcttcgtaaatcccagtttctcatgcaaaatagactctaaggtaaaaatctacgcaagccctagcacacacagctgtttatctaagaggaaaatggaattaggagttcacactttagtaagaagagaactaagatattaaaatgctctatcaacagcacgttcttccagagagtacatgaattcattttaatcttctggctttacattttcaaatcagggaagtcaccttcaggcagtgctatcggaggataatgaagggggaaaaaagaggtagaagcatatctaagagttctgataaaagtggtttaatgcataaatcaaagtgaccttattttaatgttaggcagaaataaataagcagaggttctttacctacaaaaaactaagtggatagaaacttgattaatttccaatgaatgttttttaaaaaataaattagctgctcaataagaaatagaaaaaaatttgacactgataggagaagatatttagatatcatcaccctattttggagatccttagtcaaatgagtcaatgaaagtcagattattcatagtaaagctttgtttagctaactatttaaactctgataatttaaataccacaaacaaccaattaagactttttaaaatagataaaatgaaaataaaaggaatgaaacaaggtcaatattttcaacaaaaagcatgaagtgaagatgaagacattggagaacattcttcatagcctatatatgagcagataaccttattcatagggatagatggttttgaagaaaataagtgaaattcatctttctccacaatactttataaagcttgacatactcaagacatatgcatacagtagatgaaaatgttttatgtagaataaagaccaataaactaggaggcgatataaatggattctagacttagttctactaactacctaaacttgggtaagtatattcatgtctttgtgcatcagtaaatttttttggcatagattattggatggatatattatttcttaggttctacctctcatactctagctagacacactattttgattatacatcatctaagggcttgaaggagtgcagcaaggttctctcacttaaattttcataaaaatgaaaatttttagaaggaaatgagggagggagaatctattattgcagaaataattgttttatatttctagattttctgtaatttcagcatgacccctagaaactcattttaatgttaatcttaaatttggaaggcaaatcaattgccaaaagcttaacaatgttaatataaagaatttaaaaatcgttcagccacttatgtcatcatgccaactgccttttctacccaggtccaatgagtttttgttgctgtttttgttgttgttaacattttatttatggtgtcaaatcatagctcatctacgatcatacagtttaaccaataccgtaaactcctaaatgaacaaacacaacatgcagttttctgaagacctcagataaagaccgattgtaatctcaaacttgttctttcttgtcccaaaaatgtaaatgtaagttttcactggagaatgaatacatctcatactggaatacagtcagcactcagaaagtgtttactgaagaaatggatgaatcaccatgcctaacacacacaggacaaatcagaatattaaaacttccagattctagtaaagaaactttgtttcttgcttgcaacactttcctttttccattaatctaaacttttgaaggtcaaagcttttgtctcattagttttcttgacagtaaaatgacttatgccttttctactttagaaccactgaaattcaccaataggattttcctcttgtttacttcatgggggcagccacttgacattaaaatgcttttttagcatcattacattttttaagaaatcagtggcaacagtttctccagatatgcattcttatttcaatgctatcttgtgctggtgagtaacagcaagaaatcttcaaacactttaatacgatagctagttctattcttctgagttgtgactgggtcaacctttctctacagtgtaaaaagaaatagggagaaagcaaatataacactttctctttcttttcttagacccaacaaaattttaaaaaatcatgcaaccaactggaagagaaataaatggtatatccaataactagagaatattttagctactgtaccccatttgaaagcacccatatttccctacagctacatttacataggaaaaatgtggttgggtcccaattagtttgattatttaagtcacaggtgcactgtgcctaaaatatggatggtcaacatttagtgacaagacctcattgaacaaaacttagagacagctggttttgtctggcattattaggctagaaaacaacaacaggcagagaatgctatttaattatctagagcgtaagtattaataataacaataagtgagacaacaatacattcaactttggtatttctttccaacaaggcaagcactgtttctcgttatagagttgttctttgttcacttgtatttaaatacgacatgagtttattgctttacaagagaaatgctgattatttaaagaagaatctaaagttgttgttgttgttttatcagaatctgttgtctgaaattgaatcatggagcttattgtcagtcctggatccgctatagctctagggctcttttgcagttaactcttggtcgctctccctctccctctccctttctcgctctctgtctgccaatgcctattgcatttcctcaaaaataagtatacaactcattgaagtgaggccacacagtttggaaatgcagaagagagagctgaaacttcatttattggttctcagctcagtttagtttcctcccaatgtgctgtttttcttttctccttaaaaacacaccatatattttatttaaaaaaattatatgccatggaaagagcttattgtagcaagtacatttgattaaatctggcataaacttgctagaactgagttaaacacaggtagaataaaagcttcttctaccaaggcattcaaaacctaatccacaccttttaagtacaggaactatatttttatgtatggaattgactaaaattagatattgataagcaaagtagagaaaaataaatgaaaatccctaatgcaaaagaattacattttggaaaataaagggtttgcatcctatatttggaggcaaactagcatttaggatcattactaaagcctagggtctagtgctttgatttaaatactttaatctcatcattatataaactgttttcccatttttctcacaacactctgttttctttctttatagtattattattattatttttcttgaggcagcatcttgctctgttgcccagactggagtgcagtggcgtgatctcggctcactgcaacctccacctccagggttcaagcgattcccctgcctcaacctcccgagtagctgggattacaggtgcataccaccacacctggctaatttttatatttttagtagagacagagtttcaccatgttggccaggctggttttgaactcctgacctcaagtgatccacctgcctcggcctcccaaagttgctgggattacaggcgtaaaccacggtgcctggcctctttatagtatttatcaccatttgttattatatgttaagtacttgttggctcaatgtttgttacttcgcaaggctgagctctactagagcagggacctgttctgctcagagaagggttccagtgtgcatcagtcgagttaatttataaatgaatgaccttcactctatgctacccaaagggtcatggttaaacaatcagatcttgtcctttcagtattttatcatctaaatgcatagttaatataaatacattaaggaaaggagattcaacaaacaagtaaaatacccagtgatttttttggtgacaccaatttaaaaggtgttaactctaagtagagaagagccatacttgaaatcaattttcactttcatgtttaacttcctaaatcttgaagtgatactaggagaaacagccatttaggagttgctattgtttggatatggtttgtttgtccccaccaaacctcctactgaaatttggtccccagtgtcagaggtggtgctcagtggaaggtgtctgggccatgggggtggaaccacatgaatagattaatgccctccttgtggcggagggcaggggtggggagctgtgagtgacttctcactctattagttcctataagagttgattgttaaaagatcctcctgcccgcctgacccaccctgcttcctctcttgctgtgtgatctctgcatattactggcttctctccccctctgccacaagcagaagcagcctgtggccatcaccagatgcagatgcccaatcttgaactttcccagatattagaattatgggtaaaataaactgttttaaaaataaattacctagcctcagggattcctttatagcaacaccagatggattaagacaggagtatacaggccccaaatccctatgtaaatttaaacaaactattaggaaatctttgcatgtcatttaagcattctgtgaaggaaggcactcggtactcaagagctctgaaccatagaaagtgccagtttgcttcataggaatttaaacaggctgtgtaaataggcagaatgctgaagcctctggtggaatatggcctagacaatggggaccagtctgactgctgtggaaaatgtcatggggtttacaaggttaagagtttttttctattcattgtaaacgacagatactccatgggtaaaggggacctcttctcagggaaataagttactaaagctttagagttttagcagagttacaatgggatcgaatctttactatcttcatacatatccttctagaaagattattctgtacaactgataacagtaacactaaaatattgagagacttaagcacctacaatcaataactgagacaggcaggaccacattggaacagccaatgtgactcagaaaacccttgacacattttcaagcttttggaagttacacacatttatatttaaatagaaatcaccgaatagatggccaagtgtaagacaaatgaccataaagcacacagagaatctccggcgagggacctaggaatggacgtttttaatagctctccatggttactcttgaaatgagtgctaacaaagtgcagagcagctgaaagaatcaatgtgaaattaggcactagacacttcacacatcagacaaaattaaatcctcaaaacctccattgtttagataaaaaatgaacaaagaggttccataaactcatatatcagtgtgagtgctacagttttacaaaacactggtcatctatctaacttactctgaagtaactttacacgatctggaaacctggtattcaatcatgtttcttgggtgggagaatgcaggtttcaagggaggaagacgggaggtatgaatggatatatcaatgagtccatgtttccttgaaacttgaggattcttaagtgaaacatggtttgccaatctcaggcttatagccctgtgataatgataaaaagaccacagattcagtccccattatggactagttagcatttttttttctattttatggccacagtttacattcccaaactttgactgttttacaaatagatactcttgttcataacccttagatgaagaagtgtggtttgatgaagaaaaaaccattatcattggcagaagacacctgaagtccagcccacgctggtggtgggtgatcagagcacggacttcccacataaatttaaggatagcccagcatagatggggcaggcctaagctgctggcctcattaggcatatgctgtccactcagcatccattggcttgtggagagctggggacaaggagagacagaaaagcaatgtgagcaattcaccattgcaaagtgcccatcagccaatgagtagataaagaaaatgtcacacacacacacacacacacacacacacacacacacacacacacacaccatggaatactagtcagcatacaaagaataaaataatatctttttcagcaatttggatggagttggaggctattattctaagcaaagtaactcaggaatggaaaaccaaataccctgtattctcacttataagtaggagctaagctatgggtacacaaaggcatagcgagtggcataatgggcactggagactcagaagtggggagggtgggagaaggtaagagataaaaaactacctgttgggtacagcgtacactgcttgggtgacaggtgcaccacaatctcagacttcacctctatgcagttcattcatgtgaccaaaaaccatgtgtacaccaaaagctattgaaattaaatatatatatatatatatatataaaagaaaatcagtgtgtgtatgtggagggtaagttcttcccatagatacaaccccagtgaccacttcaggtttgcttttctccagattcaggatctggtgcttgagttaagggggaaaaatcctgcttacatcctaggagtagcaatagacttgccttgtcaaggagagagaaaagaagcagaaagcaagctcttccttatacattcggggtcttactaaatcactcatctttcatctattcccacatgattagatagatgttatatgggtgtggctgtctaactttaacatggataagaatcactagcttgttaacagtgaaatttctgggtttcatcccagagtctgacatctagcttgatgacgtctagtgaaagagctatgttcctatttaccaagaatatgaagtgagggaaggaacaacagattcagagttctttatgcctaaaaatagacatattgcagtgctttcctttataaaatttgcttctggggaaccatgatttaatgttaaattttatttcactgtgctacactatgggtcttaatgaaattttatcagtgataactaataaatcatttcttaatgataacgctatcattttattaatgataaagttaaatataaattaaagaaatgagcaggaccttttagaatgtttgtttttcttattttctgttggagaaaataaaaatatttcaccccaaaatatagttctttgacatatttcaaaatggctattcaggaagggctggaaacatgataatagctgcaaagctctctgttgggcagagatctgcatctgtagagaatctgcattgatgcagccaggctttctctgaggccttgtttggatctaggaaaagattaacagagtctgatacctttaaaggtctaaaagaaacatttaccatctcttctttctgcgggctgctccctgggaagtttcatctatagaacaagaccccctttgctagccaggcctcctcttctctccctcccataacctgtcttgccgcgataacccgatttactactataggctgtttttgctcatcctgtgagccaccattctttctgtaacctcaaggtgatatataagcttctgagccccatgaggggaattcatcaccctgttgttctccccgatgcatgttaatagatttgaatgccctttttttttttttttgagatgaagttttgctcttgtagcccaggctggagtgcaatggcgcaatcttggctcactgcaacctccgcctccctggttcaagtgattctcctgcctcagcctcccgagtagctgggattacaggcatgcaccaccacgcccagataatttttgtatttttagaagagatggggtttcccgtgttggccaggctggtctcgaactcctgacctcaggtgatccacccgcctcagcctcccaaagtgttgggattagaagtgtgagccactgtgcccagctgaatgccttttcttttaaaaaattaatctgccttggagaattgcttgaacccaggcggcggaggttgtggtgagccgagattgtgccattgcactccagcctgggcaaaaggagtgaaactccgtctcaggaaaaaaaaaaaaaagtaatctgcctttgtcagttgaccttccaacaaaccttcagaggggccaagtgaaaaagaggaattttcttatacttcttactctgtttgtataagactcctatagtgtgcctcctgttggggctcagaaactgataccccaaaatatggtgctttgacatgctgaactgaagaagtcacaaggtctctctgacccatccctcacccacctttcaatcctctctctctcgcaaagtaagggatgaagttgtctcatctgcttatagtccagacctgccaaagaagccaacaattaccttgatcccttccctgagttttcattaacttaactcatattggaggaagaaagactgaagtctgtcaatgcaccaggacaaacttgtcatcaaccattgccttctgttttggtcccatttggtattttaaagagaatcatttagcagctgttgtctgctctgtgggcccaacagactttgtcccaggccattgtatattcttcaagtccagtcatttttccctaaaaatcatttactatgctcctaaaatcattcacactttcccatttcccttttccttaagaagaagggtatagaggcctggctcagtggctcacacctgtaatcccagcactatgggaggctgaggtgggcggatcacctgaggtcagatgtttgagaccagcctggccaacatggtgaaatactgtctctattaaaaatacaaaaaggctgggtgcagtggctcacacctgtactcctagcaccttgggaggctaaggcgagtggattgcctgagctcaggagttcaagaccagcctgggcaaaatggtgaaatcctgcctctactaaaatacaaaaaaattagctgggcgtggcagtgtatgcctgtaatcccagttacttgggaggctgaggcaggagaattccttgaacctgggagggggaggttgcagtgagccgagattgcaccattgcactccagcctgggcgacagaacaagactccatctcaaaaaaaaaaaaaaaaaaaatttgccagacatggtggcgcacacctgtaatcccagctactcgggaggctgaggcccaagaatcacttgaacctgggaggcagaggttgcagtgagttgagattgtgccactgcactccagtctgggtgacagagtgagactttgtctcaaaaaaaaaaaaaaaaaaaaaaaagaagggtgtataaccatcagtaccccattccatggtgggggtaatcattcagcgatccacccaccatgcatgctagtaaatttgcatatcttttctcctattaacctgcctttttgagctgatttttcagtaacccttaggatgaaggggaagttttcctttggcccctacactccatttttgcagatagggaaactgagggactgacaggttaagtaagttgtgaaattcaggcaactggtgtcagaacaagaaagattccagttgaggtctgtctggcttctttgctaaggctggcttcattgacgtgccgctgctcagtcacatggggccccatgtgtttgctgtaatgcacatggaccccaagcttggtttaatgctctgctgtagctaccctgaaatccttaacaatttttgagtaagggtccccgccttttcattttgcacggggccttgctagttatgtagctcccttcactgccatggccgtttcaggctatgatcccccaaaggtttcaaactcaaaagtcagaaattctgatcatttctgctaatgaagagataaatatacatgtgattcctactattggtagggggtagagtagaaagttgttcaaagaaggaacaccccaattattccacataagtgtttgtaaggattaatgcactaacagggatttgatcttataaattctgctgttttggtttttgaccaaatgactttaattttgttttgttttgtaatattttgttttaatttctgctggttacattagggacaaagcacttctacttcattctcatcttcctctttctataaaaacagtgtgtctttttctttattataaaagtaatgaatgtttcctgcagaaaatatgaaaaaaattacatgtaattaaccaagtagagaaaacattttggtacatatcattttaaagtacatttatatatgcgtcagtatatatttttatttctactgatatctatcaactctctaattggaatcatagtgaagccattcttacatggttaccaagaatttggacagaaatataatgaagcattaatcatgctgtactttgatccatttccttgttgctgaaagttacttcgtgaaactagaaaagttcccttttcctccgtgcagggcatgtgatggggtgtggcttgcttctttcgtgccctagagttaaaattcctagggggagcatgcagatgagcaggtcatggggagcgtgggctctgaccccatggtagcatctagggttgagtgttgacagctcccgaggccccagtaggcaagtgttacagggtgctctttcagcttggccgtcagcaggtggcttatgttaattagctcaatgagaccctctgccttatctctaggacagagggctttctgtttcccggggttcttgccttagtgtactggaaaaatcggatcacacgggggcttggagaatgagtgcaaggttttattgagtggtggaagtagctccagaagatggatgggagccagaagcgggatggagtgggaacaatctcccaaaacccttaaaaatcctagcccccaaactcctcaaaaagatggacttgaggtttcctcccatctcctgtttgagcagccctgtgattaaacttccttctctgctgcaacctggtgtcttagcataatgacttgcagcacgcagtggttatagtagcattcacgatttgaatttgaatcctgtaggtttttctcttttaatttaactatactaaggattttccttataggaaaaatgattgtttaccataactcatttaacaatctttccattgttaaaaatttagatttgttttcgacagggctcagaacaagggccagataatagcctcttggcatacttaatattttaagctgaaagaatttgagaaaagcacagaagcaggaaagtctctctgaccttctcctacccctttctctttctctcctatgaccctcgtgtgaaaggtgtccaccctatacccacaggacaggagcatcgttatctctaagactcagggacacagaagaatctgcacaaacaggccttgctcagttccctccagtttattgccatgagatcattctccctttgtctaatcttacttctccacgattatctacttatttaccaaacttagcataaaaatacatggggttacttatttctttgggctttcatttcctgataaagactcccatgtcatgcaacacttattaaatatattagcatgcttttctcctatcaatctgtctttgtcagtttgatttttagacccagccaagggaccctaggaagagtgaaggaaagcctttcctcccctacattttattctgtttaagttttgttgtttatgattgactctaaatcaaagagagcatgctgcaaggagcaggcatcgtccaggatggttaatggggaagacatcacacactcaaaactgcagactgcaagtctatgaaccagggaggttttctgtacttctgtggcatgaaaatagaatggattattctatattattttatatataccaaaagaaaatgaccgaggcaggacaggcagtcttggtgcaactgaatggtagaattaagtgggtaaataaaaaaggtaaggggaaatactatttgcagaatctaattgtcagcctttttaaaaaatcaggaagctaattatttactgcacagacaagtcaccaaggcagaaaaaaaatgtgggtggtcttggggtttgattatttctaccaagcagtgattatatgcattagcatctgattcacttacatgctaatatcttcactgaggaatctgcttccttttcagcaaaacctgcttaagttttcagcaaaacctgcttaagtcagaagtttgttacctaggaagcctttattcccttcttaccacaggagaaactttctttacattttgggcaagactaagtttagatctagtctacatccagagttgtcacacagtatttttagaaatagactggactgacccagggaaaggaaatactttgagagcaaaaccttctaactgccaatatctgttttacaaactttacaagtctgtgttcctttgatgcagcttccaaatcacaggacttcttgttgacaactcaccctgcttgagttccgtctttgtcccagaaggaaacaaaatgtatttttcccctttaaacacagaggaatttctttagataacctcagaacacaattatccggtccagtcaaacaatctgaagttatagttctgctgctgtctctgacctaactccctcttcttccaatgtttcacagctctttctattttcatttccttttgatttttcaattatctctattttgcttactgtgggaacttcttttgaaagtgattattgactttgctctcaacttggtttgacttaataaattggtaacataaataagacctaaactgggcagaaacagaaaaagaggttgttcgtgtcaaataactacctttcatgtatttgaaaggtgaagattatagaatgtccaactctgcttctttctggtgtggggacaatctgagctgtgataaagttttgacatgggaacagagcaggataagcatgtggtaggacgggagtggggtgatgaaggactttgggaagctgctggatcaaatttgagaaaaagaaggttcaaaaggcatcccaaaagagcactaaagctggtttagatttagtcattcaattgctcccctcgtcttcattacctctgtgtaaagacctaataacaaagtatgaaaaaaactgtgctctaaaccggaaggtgctaaataaaaacggcattattactaattactttagctaactaagttgactgaaaacttattcaattcacatcagcatataatgctataaattttcctacaagcactgctttagctgtgtctcccacaagtttcgatatgttgtgttctcattttaattccactgaaaatgatttttaaattcccattgtgactttttaatgggttactcagcactgtgttatttaattttaagatattaggaaatttttctgtttttgtttttttaatccgatttaattccatcgtggtctgagactataccttgtatgtttctaattcttttaaatttgttgaagtttgttttatagcctacaatatgatctctcttggtgaatgctccatatgcacttaaaaagaatgtatattctttttaagtcaggtcaagtttgttgattgtgttgttaagttctatatccttattgattttctttctactagttctattacttactgagagagaagtgttaaaatttccattataattgtggatttgtttatatctccttttagttctattagtttttgctttatgtgttttgaagatgtgttgttaggtgcatacacatcattatttaatactcttctgcatcttcattaatattttagttctgaagtctaccttgtctgagatatatatatatacacaaacacatatatatatacacacacttatatatacatatatgtatatatgtatatatgtgctatatatatatacacacacacattctgagacatatatatatctcagaagaaggttgtttctgccaaattcatttatttgaaaggtggagattatcgaatgctccagtggttatatatatgttgggaacaggcccccaaatctgtccataaactggccccaaaactggccataaacaaaatctctgcagcactgtgacatgcttatgatggccttgatgcccacaacaggtttaccagaatgagggcaaggaacacctggcccacccagggcggaaaactgcttaaggtgttcttaaaccacaaacaatagcatgagcgatctgtgccttaaggacatgctcctactgcagataactagccagacccatccctttatttcagcccatccctttatttcctgtaaggaatacttttagtaaatcttatgactggcttgctgtcaataaatatgtgggtaaatctctgttcaaggctctcagctctgaaggctgtgagacccctgatttcccactccacaactctatatttctgcatgtgtgtctttaattcctctagtgccactgggttagggtctccatgacagagctggtcttggcatatatatttcttttaattaacatttacatggtgtatttttttacatttatatgctatatatatttaaatgacatatatacatattttcatccttttactcttaacctagttctttattttaaaatgggtttcatgtgaactgtgtagttgggctttgctttgtttgagttgacatgatctgtcttgatttgttatgttgagaccattgacatctgtgtcactgctatgtttagactaaaatctaacatctggctagctgtcttctatttgttctgtttgttaatctttcccctttccctctttttctgtttttttaattaaataatttttatcattctatttttcctcaactattgatctcttgtttatgtttcttaaacatttatttttttcctatagaaaacatttcctattttaattttaaattaaattaaattttaaatatggattttttcctattgcatttatgatatactttcatcattatttgtagtttatccttgaataattttattctgctttatatataaggtaggagtctcacaccaatatacttccagtgtttctctctgatcttttgtgctgctgttgtcaaaaattttacctttacatatgctataaaccagcaacacaatgctactacttttcctttagacagtcaactatctcatagcatgactaaacattaagaaaggagtctttttatttaccctcacataattttcctttgtgtgtgtgtgtgtgtgtgtgtgtctgtatacatttacaaacatacatatcttcaactttcccatttctttttgaggatccaagtttctgttatagattgtttctgcctaatgagtgcctttaaccattcttgtagcactgtctgctggcagtaaattctcttacctttcatttgtttgaaaaagttattatttgctgtggttttgggaggtttttaacctgaattctgagttgatttttttcctccagccgtctgaagatgtcaaaccatatgattatctcaatagacacggaaaaggcctttaataaaattcaacattccttcatgttaaaaaaactctcaataaactaggtatggaagggacatatctcaaaataacaagagccatttatgacaaacccacagccaatatcatactgaatgggcaaaagctggaagcattccccttgaaaactggcacaagacaaggatgccctctctcaccactcctattcaacatagtgttggaagttttggccagcgcaagcaggcaagagaaagcaataaagcgtatttaaataggaagagaagaagtcaaactgcctctgtttgcagataacatgatcctatatctagaaaaccccatcatctcagccctaaagctccttaagctgataagcaacttcagcaaagtctcaggatacaaaatcaatgtgcaaaaatctcaagcattcctatacaccaacaatagacaaacagagagccaaatcatgaatgaactcacattcgcaaatgctacaaagagaataaaatacctaggaatacaacttacaagggatgtgaaggatctcttcgaggacaactacaaatcactcctcaaggaaataaaagaggacagaaacaaatggaaaaacattccatgctcatggataggaagaataaatattgtgaaaatggccatactgcccaaagtaatttacagattcaatgctattcccttaaactaccattgacattcttcgtagaattacaaaaaactactttaaaattcatatggaaccaaaaaagggcccatatagccaagacaatcctaagcaaaaaaaacaaagctgaagccatcccaccatctgatttcaaactctgctacaaggctacagtaaccaaacagcatggtactggtatcaaaactgacacatagaccaatggaacagaaataataccacacatttacaaacgtctgatcttcaacaaacctgacaaaaacaagcaatggagaaaggattctttatttaataaatggtgctgggaaaactggctagccatatgtagaaaattgaaaccggacctcttcctggccgggcacggtggctcacgcctgtagtcccagcactttgggaggccgaggcgggcggatcacgaggtcaggagatcgagaccatcctggctaacacggtgaaaccccgtctctactaaaaacacaaaaaattagccaggtgcggtggcgggctcctgtggtctcagctactcaggagactgaggcaggagaatggcgtgaacccgggaggcggagtttgcagtgagccaagatcgcgccgctgcactccagcctgggtgatagagggggactccgtctaaaaaaaaagaaagaaactggaccccttccttacatcttaaacaaaaattaactcaagatagattaaagacttaaatgtaaatcccaaactataaaaaccttggaagaaaatgtaggcaatactattcaggacataggcacgggcaagtatttcatgacaaaaacatcaaaagcaattgcaacaaaagcaaaaattgacaaatgggacctaattaaactaaagagctttggcacaacaaaagaaactatcatcagagtgaacagacaacctatggaatgggagaaaatttttgcaatctattcatctgacaaaggtctaatatccagaatctacaaggaacttaaacacatttacaagaaaaaaaccaccccatcaaaaagcgggcaaaggacatgtacagacacttcttcaaagaagacatttacgtagctaacaaacatatgaaaagaagctcaacatccctgttcattagagaaatgcaaattaaaaccgcaatgagataccatctcatgccagttagaatggcaattattaaaaagtcaagaaacaatagacgctggcaaagctgtgaagaaataggaacgcttttacaccactggtgggaatgtaaattactttaatcactgtggaaaagtgtggcgatttctcaaagatctagaaccagaaataccatctgacccagcaatcccatcactgggtatatacccaaaggaatatgaatcattctatcataaagacacatgcacatgtatgttcatggcagcgctattcacaatagcaaagacatggaatcaatccaaatgtccatcaacgatagaccggataaagaaaatgtggtacatatacaccatggaatactatgcagccataaaaaagaatgagaccacatcctttgcagggacatggatggagctgggagtccttatcctcagcaaactaacacaagaacagaaaagcaaacactgcgtgttctcattcaaaagtgggagctgaacaatgagaacacatggacacagggaggggaacaacatatactggggcctattgttggggtgggggtagggagagcatcaggacaaatagctaatgcatgcagggcttaatacctaggtgatgggttgataggttcaataacctacagtggctcatgtttgcctatgtaacaaacctgcatgttctgcacatgtatcccagaaataaaatgaaatgaaataaaataaaataaaattctcatctttattcttctgaatctaagatgtctgatctttggacttcagctatttgaatatggtgtgtaggtgtgtggatttctttttctatttatattctttgaggttttatgagtgtattggattcttgctttgattctttcattatatttggaaaattctcaacaattccatcttaaaatacttctaccttattttctctttatattctgtctcacatttcaattatacatatattcaatcatttgatattgtttaacagctcttcaatactctgttctgtcttcatctccttttttactcttttctttcaggtgggtaatatctattgacctattaagttcattgattctttccacgactgtgctgactctactgataagcccatcaaggacactgttcatgtttgttgctgtttctttttcatagcatttccaattgattttttgttacagtcaacatctctctgtgaaattccgtatctgttcaggactgttactcagcttttccaatggatcctttaacatattaaacatggtcattttaacttctctgcttgatagttccaatatctaggtcatatttgagtctagttgataattttgcctcttgatcatgtttttttttttccacatgcttttttgtacatctcataattttttaatgaatcacaaatatcaaggataggacagtatgggctaagataaatagtatctatgtctggaaacggcacacttcttttagtaggcctacagtgctggagttggtcaatctagttagaagttgagctgggtttgggttttgttattgctatggttaacctcagtatattactagcttcaaattcctctagtgctaccttgtgtgtaggtgggggctatggtatcaaagggcgtgtctcaatgtccctgctccaccctcagctttctgctttctttgagtgtctgcaacacacagggagctcttccttgctctccccactcagaagtagagtgccattgcttgttacctggtgcttataaggccgacgggagtggagcagcgaagaggttttccattgtcctggccccccaatagtcttagggaggccctgtgtgtctggatcttaggagtggggcttgctctgtgatcctgcccctcctcccagtgtcaaccaaattctgccttgcatctggtagatctcccatgagagatggtttctcgtccatccccttgtggtaggagacatctaatggtattggtgtaggatctcggacttaggactcttttgtacccctcacccaggtatggagattgttttttttccttgtattctttccttaaccaaaatgggtcatacttgtgcctaggggcagcacgatttgctgctccttctctatcggcttaaggcttttgttccataacaggggcaggccagatggtgcttaatatttttcctgaagtggcccatcctccaggctcacaccacctagagaggctctgtcctgtctccagctctgtccttgatccttctcgtgggcacccagtaaaggtctgtggaaaagagcctgtgactgggtaggagttccctttgtgcctgcagcttctggggttctgcacccacacactagcctacacttggcctttagcaatttgttaaaaggtttagctgatttcttcttttaactgtatggagcctgatgcctcttcctccagtgctcacaacccacatcgtcctggaggagcttgtctttcttaggatttcaggctacttgtttacgtgtgacctcagctctttgatgggtttaagaacatttatgacatggtagtttatcttgcttttccttagccttggtggaagtggcaatttgttcaattatatgtattgtatgtgtatgtatgtatgtatgtgcatgcaatgtggttgatgtttcctttcaaaaacacagcttagaaaagtgaaggctacattacaactattgaataagaatattttaaggaagaaaacagggataattaaaaaaaggaaaaacccaatgtgactctatctaggctttgagctttttcccagtaacgggaagaaggaaataggaatttcttaatgttctttatctgaactaggttctgtggggaaccagagggaccaaatgctgatttaacattggaaaccagatgagaatatgggaagcctactagtctcttaaaaatatttaagaagtggattttgcgttttgtctgaaaggaagaattcctcatttggacaagaaggttatttcataagtgcatatgaaaacaaaagttaaatccaatctctgaacctaaacattaatcaaaaaaaaaaaggtctttgatatacttctccaactttgtacaataaggaggtataagttggaaaactctatagtagcagagtttgttttgtttttgtgtgtctgttactcactgaatagttaggggcatggtagctgttctcttcctctacaagcaatcaccttgtctgctttttattataaaatttgatggcttttttcctgtttttatctctcttggtctcattgcacccctgcttcctgtggcttctgtgaagctatactcttctggttctaattctgatgagcctctcttctctccctcacgcttttgacatgctaatgttcccagacttttcaacctcatatcctgacctcttgcttttaaacttcaatttaatttaagacgctccacttatttaaattttttaagagcacaaagtgaacttttataattttcttcatgtggttctgacatcattgttgttaggattcttccttagtattttatgatttttacatcctttatgaatcaacccagcctccaattatgtcatctactgtaatgactggaattaaaaaaaatactgatatgtattatgtgggacttctaaaattgacattaattcaaagagatttttcttaatttttctttgttccttagttttatctcttagctgtttacatattaatcttatctctttccttttattgtcatggtcagaacttttggaagcaataaaaatagtgaagatggtaatttttgtcacatttctgattttattgaaaatgcctttatggtacacggttatgtataacattgattgttaatttaaaattaattttctgtatctttatcttgcatttcagttgttatctctatatagtctgtgttctaatgaacttttcttgtttgtgtcctatatcatgtatattgttttctgtagaattgattcttttcttattgccttaaataaattcagtttttatatttatattttgatttttatatattttatcttccttccttccttcctttctctttcttttttttttttttttgtcttgttttgtcacccaggctagagtgcagtggtgtgatctcagctcactgcaacctctgcctcctgggttcaagggattctcctgcctcaacctcccaagtagctgggactacaggcatgcgccaccatgcctggctagtttttgcatttttagtagagatgcggtttcatcatgttggccaggctggtcttgaactcctgacctcaggtgatccacccaccttggcctcccaaagtgctgggattacaggcatgagccactgcacctggttgcctattttttcttgatatctgcaattttgtttagacttacctttcctatctttttagtaggattacattttaaataataaaacaagggtgcactcctccatgcccttcttcccgttcattcagtcagcagtatcaccttcaacctaatataaaaagcaagattcagaatcttgcttggatgaccaagtaaagaggacctgagatatcttcctgagagcatttgaaatttccttttgcctcaagaggggaccagctctaaaactcagaaaagacaaaagtcttaaaaccaagacaagatatggcaagagtgggacttttgaaagagattttttttccggtttcataaatttgtgccattaacaaagttttggaaagagaataaacagagacactggccaccttccccaatcaggtacacattttttcacttggctgagagggagatttatagaggggaaaagcttaggcttggatgcttttagacatagatgtatccccatgagacgtctgggtgaacaaaagaacccctaaagagttctagtgatctggaaacaggacaaattgtacttccttttccaggggtgctttctaaccttgtagagaattcttttcttgctaacaggttatataaagaatataggagacaagatagtaagagatgatcaagtaaagaagacctaagacatcttcccgagaacataagaaatttcttgtgccccaagtcagggccagaaagacagatagggctggtggccctggaggggctgcatcatgatggtgacagggtgtgtctgtggaatttgacatcaaccttcaactggaaacgacataatataacacactagatgccaattgggatacacattgatgaataaagacaagaaggaaagggaaacaacttcagatttgacttctctccaatgccatgaagctacatcagatttctccaccccgagaacataagtgcctccttagaaagaaggaggggtaggcggaatcttcgaagtgatttaatttaaacctgaatcgatcagcagaaacaaattctaaagagcctgtgtttacctgaaactgcctgagatgatgatgattattttttacctttaggcagaatgtggaatctatgtttttggggatttgtttttgagacaaagtctcgctttgtcggccaggctggaatgcagtgtggtgatctcagctcactgcagtctccgccttctgggttcaagtgattctcctgcttcagcctcccaagtagctgggattgcaggtgtgtgccactacgcttggctattttttgtattttttaagatatggggtttcaccatattggccaggcaggtctcgaactcctggcttcaagtgatcctcccacctcggcctcccaaagtgctgggattacaggcgtgagccactgcgcctggccagaatgtggaatctagaaaagaatcaaagcaggttatagaaaagtaaagaagctatttctctcacataggctttgtcatggcctgtgaaaatgtaaacccaccatattttatcagaaaaacctgtatatatttctcatctgctatatgtccttttcacagatatgctttttcctttgcttaaggtactttttgccattcttttttttttttcccctggaatcttttcataggtttcatttatctcatccctgaatgaagagtgagtcaactgacctatatttcctttggaccctcccagttctttaggatgctgccagatttgtcctcttagatctcaagggagaatggagccgaataggttcagagtcctcagacaaccttctcgtgacgtgactcacagctatgtttaaaatctgtgtctgctggactgaagcagaagcttttttataggctgcctgggttaacgtcctggcttgtccatttactagctgtgaaggctgagcaagttacttaaccctcctgtatttcagtttacctaactataaaactgagctaacaatggtacctggcaaagttgtaaagattacatgaattaagttaatgaaagtacttagattagtgtctggcacaaagtaaacattgtgtaagtgttggtcggtatatttttgtcatcattattcttacaggggtctcctctctctttcaaatccagcttatcttctgttttgtttccagattaatctttctgcagcacagacccacatatattattcaattgaacaaacactttcaaaggctccaattgtttaccacattaaggaccaccttcttgccttgggattcaaataattctggtacagggatcaggacttcgtcccaacctctcactagtctactgcattatgctcagtccgtggtggggatctgattgtttccttgaacttgctctgttcttttctgcctcagagctgtccttactgcccctggcactttccatcttccccatttacatctgtctcagcagatttaaattctaccttctccaggatgccaatcataatttccccatcaaatgtaatctcttggtctttgcaagccccactgtactttgtcaaaagtgctcaccacgtggtactgagaactatagcttcctgcaatgtggatgtagtcatcctccatttttccttcccttctgcctccagacacctcacaggtaggagtttaggctgatttatccgtgtattccctaaaattccagccacatgcttttcatgcaatggcagtgcaacagatagttatattctgaacggaaccaatacagataaatcccagttaagaactctagcacacaaaacaattttcttggttctacttttgctgcatcatacagcagagcttcttaacttgctaaaaacaaaagttttaaatgtttcgacaaaaatattcagatagatatactttcccacaggatgtcagaaaccattgaatgtcaacaaatatagtgggatatttttctacgaaggaggaagttgatactaatcattcagcataattttaatctctcatataattgatggctgcagattcttttcctttttctttttttgagacaggatctcactctgtcactcaagctggagtgaagtggcacaatcttggcctactgcagccttgatctctgggactcaatcgatcctcccacctcagccttctgagtagctggggctacaggcccacgccactatgcctggctaatctcttttgtatttgtagagacgggattttgccatgttgcctaggctggtctccacctcttgggctcaagtgatcctcctgtctcggcctcccaaactgctgggattacaggcaggagctaccgtgcccagctggttgcagatttcataccagcagtcaaattaaagtacataaaaatacaagaagatattgtctattaaaatctacagagaacatgagtatttaagttacaaaatatggggaaaaggttaaatgtcttcacagaataaatcaatcaacaaatatttattataagtcactgagtgatataaaaaaagtaaaataaggcttttataccccaggagataatgcagtgggtaagataggagaggaggctgtttcaccagtccagggctgcagtgattaggattggagaacagctgtggtgaagagttaggtaaaaggaaaggagaagcaaagctgacttaaagaaagaacaaatgggaaatggagattaaataggggcaacggagaaagactagtttaagatattgcaacattttaagctattgagaaaaccgccaatagaaatatggaaaaaaggaggaaattattggggatggcagtggaagaaagaataaggacaaaataaaatgcaattttaagtgcactgagattgtagaaaggtaaaatgttcaggtataaatatccagagggcagcagatatttgcatggtactttacactttaaaaagcccttttatatttattattttgtttgagatctttagacatatgggcaagtcagatagtttaagtaagttgtgtaaaatcctaagtccagaagtctgaacatgaacctaaggtttggactcctagtacccttacaagcactgggtttgttatcagaccagctttggatttacttgcttaagttgttagctctgtaactttacataagttacttcaattcctctaagctgcatttcccatccataccttgacctcccaggctcaactgattcttccacctcaaaactatcttctagttttgttgtaagaattagatgacataaagcacttaagtaattggcatattctaaagtcttaacaaattttacccattatattatttctacacctcagctgcttcccagagagcctggaacttgaaaatagatctgtctgtctgtctgtctgtctgtctgtctgtctatctatctatctatctgtctatcatctatctatctatctatctatctatctatctatctatctatctatctatctgtctgtctgtctatctttttacaggcataccttggagatagtgcgggtttggttctggaccacagcaataaagaaagtcacatgatttttttcagtttcccaatgcgtgtaagagttatgtgtacactgcactgtagtttattgaatgtgaaacagcatattgtcttaaaaataatatgtgaaccttaattaaaaatactttattgctaaaaatgctaatgatcatctgagccttcagggagttgtaatctttttgcggtgaagggttttacctcaatgttggtggctgctgatgatcagggtggtggttgctgaaggttggtgtggttgtggcaatttcttttctttttttacttttttttttttttttttagagttgaggtcttgcactgtcactcagcctggagtgcagtggtgcaatcatggctcactgcagccttgaattcctgggctgaagctatccttctgcctcagcctccctagtagctgggactacaggtgtgtgctgccacatgcaagtaaatttctttctcttttttgtgtttagagatgaaatcttgggtctgggtatgttgtctatgctggtcttaaactcctggcctcaagtgatcctcccaccttggcctcccaaagtgctgggactacaggtgtatgccaccatgcctggctaatttatttcactttttgtaaagatggagtcttgccatgctgcccaggctggtgaatattcttaatagcatctagaataattaattatttccagaaggtttcttaatggaccttgacaaaatccatcagaggaatcactatctatggcagctatagccttacaaaatgtatttcttaaataataagacttggaagtcaaaattagtccttgatctattgggctacagcatggatattgtgttaacaggcatgaaaacaatattgatctccctgtatagctccatcagagctcttgggtgaacagggacattgtcaatgaacagtaatatttgaaaaaacatcttttttcttctgagcagtaggtctcaacagtgggcttgaaatattcagtaagccatgttgtaatcagatatgcttccatccaagcttgttgttccatttattgagcacaggaaaagcagatttagcctacctcttaaaggccttaagatattcagaatagtaaatgcgcattggcttcaacttaaagtcaccagctgcattagcccctaacaagagagtcagcctgtcctttgaagctttgaaaccaggcattgacttctcccctttagctctgaaaggcctagatggcattttcttcctatacaatgctgtttcacctacatttcaaatctgtggtttactgtagccaccttcactagtgactttagctaaatcttctggataacttgttgcagcttctccatcaccacttgctgcttcactttcacttttatgttagaaagacagcttctttccttaaacctgatgaaccagcctctgctagcttcaaacttttcttctgcatctttctcatctctttcagcctttatagaattgaagagagtcagggccttgctttggtttaggctttggcttaagggaatgttgtggctggtttgatcttctacccagaccactcgaactttttctatattatcagtaacgccattgcactttcttaatgcttgtgcatttactggggcagcacttttaatttccttcaagaattcttcctttgcattcacaacttggctaactttttggtgcaagaggcctagcttttggcctacctcagctttttacgtggcttcctcactaagcttaatcatttctagcttttggtttaaagtgagagacgtgcaactcttcctttcacttgcacgcttagaggccactgtgggattactaattggtttaatttcagtattgctgtgtctccggaaatatgaaggcatgagaagaggcatgagaatagctggtgaatggaggagtccgaacacacacacttattgattaagtttgctgccttatatgggtgcagttcatgacatctcaaaacaattataatagtagcatcaaagatcactgatcaaagatcactacaatagataacatactcatgaaaaagttgaaaatataattgtgagaattagcaaaatgtgatacagagacacaaagtaggcacatgctattagaaaaatagcactgatagactcgcataacgcagggttgccacaaaccttcaatttgcaacaaaacacaatttctgccaagcataaaaaagtgacgtgcaataaaatgaggtatacctgtgtactgcagtcttgctgccaactctgactttattctatttctcccttgccactatatgtaaccattgaaattaatttattttttaaccttccagtgtttcctaatgccaatatatgtatatatttaataattatacacacatatataatatacatgaatatagatctgtaactgcctatatatgtataaatccatatgcatttgtacatatataagcagttacagatctatattcatatatattacatatgtgtgtataatgcatatatgtatgcatttatacatatacaagcagttatagatatataaaacattaaagcagtcttttgtgtattaaaatttcaggtgcattggtatatattaaagcattaaagcagtcttctgtgtattaaagggagccatatatatatgctttaaaaggactgctttaacatataccaatgtataagaaattttgaaaataatctgatgaaggagtaaactttttacccaaaatagatgttcaacttttctttctttccccaactgttctaaaggactccagtaggggacctctgtcattctggtgattaagtatctattgtgtcactttctggaaacagtactacgcattttcttttgagaaacgatttttgtcttggcattggccttatggtttgtgtaaatggaattcatactcaggattcgaggtgggtttataaactttagtcattttattacaagagccatattgggtttaggcatatgctttaagccaactagactgaactctgggaaattgtttgaaatgctgagacagaaatgatctcttttgtgctggatgtaaaggaaaaagcccttgagcacctatgagaagactcagctatagaataaaagcaacatcctacaaaatggagcagacaaaaggcagacacaggatcactggtgatgtttcaaggcccctggagtaagccctacttactccatgaaaatgaagtcgcttccttcatctcccttcagatttttcataatctgagttaacaagttctctttaattttggagctaatatgaattaggttttctgttacttatagctgaaatgatcacactgacatagtttttttattatgtataaatatctacacatacttgaatgtattttggtatttatttctattctcataagcagtatgtttattcctgtgccaacattagtgttttaatttctttaactttattctttgtgttagagaaactttattactcagtcccatgtttcctagtggggaattcccacttctctctcccatactaactctctccttcccttgggaagaaaagtgatttatgtgattgagaacatggagttcttgccctgtctctctgggacctgcagggcctgcaagtgtgtactccttttctgcttcttctggggctaacagtatgttttgatacttggcggagaaagtgtttccatattctgtagtttttttccctttcttcttcctcagatttcttggctcttctttcatgtttcctcttttagatacatttttaggtcagcattttagaactgatggaaacactttctggccctttgatcagaactgtattaatttcatatcataactgtagaggaactggtatcttgttcaggagcttggtgtatttttctgtgtactcagggcttctatgtataatatatcacaaaagtttaatagttgtcttcaataggttttatatttttctttgtatatttatttccagctgtttgatgatattggttactatggtaaagagcactaaaaaaatctaattggtagggtagtgtacaagaaaaaccatttgtgtttgcttattaatttttattctggccaacttgattaaatcttttattagtcctacatagataataatatcttaaataatagaagttttctcctgtcaccccactacacgttttgaattaactgtagtgactaggaattatagtattgaataatacctgagataacaggtaaacatatcttgttcctaacttttattgataagcacttaatgtcttaccattgattatgatgcttgctattcacagcaagatagaagttttgtctattgtttgctatttctttgaaaatcaagtaggttttgtattaaatattttttcagaatcaaataatacattttttctttcatttgttaacatagataaaaaaattgatatgctaaattgaactagctacacatagttcatataaatggcactttgtccacatttttaatgctttagagtcattcttataattttaattcctaatagtttatttaggagttttacatccacatttacaagtgagactgacttccagttttccttgtctgtgtgtattctttaatctaatttggtatcagagttttgttagccttttctaattccagtctaatttctatttctagttaagataattgcagtctttttctactacctggatgtagtttcagaatataaaaattatttgtttcttaaagattcagtagaaatcacctaacattttctgaatttcatgcttattttagagatagatttttgaccaccttatcttcttctgtgattattattgtcttgaaatattctattattttagcgaattttggtaatgtatatatttttgaaagctaatagttgtgtctacaattttcagatgtgtacaaaatattctcatgctttcttgaatccctgagtatatcagggattatataactgtagctatatcccatacatttatctgtaattatgtcccttttctcactgctaacatcacttatttgtagcatttcttttttcccctttgatcaaccttgccaaggatttgtcaattttcctggttagtttaagaaatcaggttttgatttattgctccaactctagtattgtttattttttcattttgatcgtttctggcttatgcttttctatctttgaaagtcttcaaatataatgcttttctgatcacgttcttcttgagacacgttctgttttttgaatgcagattacgtatagtatacatctcttctctgtctctgtctctctctttctcattccagaatacatactagaaaataagaatataataagaaggggttggtcctggtgactcaaccaatgttcttctcttctcgagttcaaatagtacagcataaggcacaagtctttatagttctgtcaattatttaaaagtcaaaattctattaagtttgtctgatcttcctgtattccttcatgttaactttgagcaaatgcaaccatcaaacagacaatggaaatgcctagtgcctgaaccacatttactcattcagtgtacaaggattgaaacacgcacacacacacacatgcacacatgctggggctaggcactgtgctggctgccaggacacagagatgagtcaaacaaggtccactgcataaaagaagccctgagaggagtggagagaagcactcacacggtgcataatccactgagaccaggctttagtgagatgtgtaccgagtgttctcaaagcaagacgagcagtcagggatggatgctcaggaagtggcatgaattgagtccacggggcactgaagtatgccagcctgtgttcaaggccacgcttagtgtgctttcctctatgcaagttagcagcaaagtcctccgtgcacacatgcccaggaattttaaatgccatttctttggggaaaggaaaaccaatgtaacttaataatatcaaagtgaaataaaagtcttttatttcagaggtggaaagaccattgtaaattaaactgtaaatttagtctaaatctcacttcacattacttctgatatttttagcaacactacttaaattcatattatactcacttatcgttgagtttgtgaataacatgtatttacttcaacttataaattttgatataacctttgaacttttgggttaacccaaagaaacatgtaaatggcagaaatgtattgctatttaaagtaatttaaatgcgatctatttctacaaatgtttgttgcttttttatctctgatatccaaaaatcaggagaaaaggaggccttaaaagttgtaattaggccgggcgcggtggctcacgcctgtaatcccagcactttgggaggccgaggtgggcggatcatgaggtcaggagatcgagaccatcctggctaacacggtgaaaccccgtctctactaaaaatacaaaaaaaattagccgggcgtggtggcgggcacctgtagtcccagctactcgggaggccgaggcaggagaatggcgtgaacccgggaggcggagcttgcagtgaaccgagatcgcgccactgcactccagcctgggcgacagagcgagggtccgtctcaaaaaaaaaaaaaaaaaaaaaaaaaaaagttgcaattaaactaaaaactgcttaatttttaaaaaaggtttttgttttgttttgttttaagaagtagcagttggtaactgtctctagctcagagacaatacatggccaggaaaagattgctcatctcaactcagaggataagggccacaaaacagcacgttcagtgccaagaaacctacgatgtggctgtagctcacacagaagcccgggttctagtcctgagacctccaagggaaacttctgcccttggaaattcaccccttttccaatcattacgctagtatttcattggcagaaaggcaggctgcacaatcagctgtcatgcccccagccctgcatgcatcacctttccacattccgtgggtgtaggacgaggctagggcgaggagtgggtagaagaaattgtatttgcctttggtaattttaagtttgaccactgcattgcgtttagctgttttaactgtgcaggtcagaaaatgtgcccaggtttgctaaaataaatgcataaatgcaactcacgaagtgccagtagtacttccttcagccggcagagggcagaacagaggaacagaacttcacaaagcaaggcgctgcctgtcttctcagaccaaaacacaaaccagaagctgtgttttcctttgtttcttcagaaaagttgtacgtagaagaatagcatttttgaaggaggactttcaccaaagcttttaatatcagaataatatatccactttagtatttgatgtgtccagtgtcaagacatccagattcacccaaactgtggcagggatgaggcaggagagacccgaatacagagctgtccagtgtgccaatttcagtcaattcttagatcaatccggagtgtataattctcagaaaggaaaagatttgtggattttgttatagttgtttcatgccaatgaacgttctcgtcacattctgatcgtttaaaataaaatgcactagatttactttaacactttggtctctgaaagagaaagaaagccacgcggcttaataaaagcaacccaatgcaagtatttgttttaaaactgcctagctaaaacacagcgccgctggattacaattgcctctttgctgaagcaaaacacacatggtgcttagattctacttcagcctgaactccttttgaaaggaaagggagaaagctgtagtggaatgtgattcacaattcagcctttctataaggcctgacactcccatgaggcttaaatggaatcacacagtgaattttccaccggcgaaatttactagggaaagccgtctggaagctgtcttttagtagaagcacaggaagcccgtgcgatcgatgaagaataccgaccctcctctagctacgtctggctcccctttccctatcctgcttcccaatgtacttgttccccatgacccagaatggattacaatgccttctgcctcaccattatgaaaaaagggatttcagggtttctttctggggggatgaaattgaaaggttttaatatttaggctgtagtgatggttgcgtagcactgctaataaatataccaaaaaccgttgaactacacattttaaattggtgaactgagtgatgtgtaaattatttcttaacaaagctgttaaaaataaattgatttatctctctacgatagaaatgaatgtaatgtaatgaatagtaatattgaaactcgcttgctttttagctaaaatgagagtcaaagcaacattatttgattgccagattctatttccttttaagttttttattcttccatttggtgtttgtgtgtctgattttctttctagatttttcttttagtgtttcaggtccgaagaaaaatcttggtttttgtttatttactctaagaattgaaaaatctatagatggggtgcagaaaatgctacctcaaaatatagcccctaggcatactgagtaacttgagaaaacagtggaagcagggacatctctgactttctcctattccctctctcctgaagcagatcatagaaactgacattcttctgtcccctgactcccctgaagtgggccatagaagctagaattcccttcataccttcttccctgaagtaggtcataaaacacaggaagaccactctctgaccatctacctctctcctcccataataaccctcataccctgaagaaaggaatgtcacacagagaggacatgaagaatccaaacagacaggccttgttcagttcccccagcttatcaccattagatcacacccattggtcctccaatcacactactgtgtgactgtcaatacaaatacagtttttcctggggctttgggtctcctttctgaaggctcctacgtcaggtaaaatttatattaaataagtctgtatgttttgctcttgttcatctctcttttgttataggggtctcagccatgaacctgtaattggatgaggaaaaggtattatcatttctcccataccctgtattacacaataaaaaaaaaaccagtaacatcttgtatttgtcctatttgaaaattttatttattagcattagctaataaattatttgtatatatgcaaaacaagattggaaatgacttcctgttatatgaaaatgatttcatcatgtgatataacagctaaatattttaaagcaactttaggcagcatttaataaaggtgctaacagtgaggaaggaagtatcttctacttggtacaggtcagacacatctggggtttggtgttagctttaaacaacagtgtagcctggaatatttccagtagaaggagaaagggctcaggcacacttaggagaaacctatttctacctccaaataatggaagggctgtcacatgaaagaatgaacttctttgacacagctcttacagtataaaattgtatttgttttacaaatagtacaacaggtataagttctaaggagacacgaaagaactccgtaatgtttggagctgtctaaatgggagtgagttacttcattaaacagtgagctcctatttgagaagtgtggctcatgacctggaaatgattatattgtgggaaggatgtgctaattccaggtccagcttgtaactgatatctggtgccatccgcaactggcactcggggtgtcctttggggaagtggttgtgtgtggactaactaagctatatcacttgatgatcagatcattttgccaaagcacacctatgccagcttttaaaaggctcatgtaattatattaggcccactaaaataatcaactttttgccatttaacataacataattaagggagtgatatctcctcatcttcagaggttccacccacactcaaaaggagggaattgtacatcagcgtggggcattaggccactcttagaattctgcacttcacagggtgactggaattaaaacattccatggttactgtagtgttcagagaaggctaaagtgtccattggctttggagctcctgcttcactacttggagacctgtattttttttcagctcttgatgctggaaggaaggttctttccaacttgatgaaacaatcaccaaatatacaccagtgggggctttcctgagcccctgctcctgaaccaggtcctctccttcctcattcactcctagaatctctaggactccagcctataccaagttcaaaacttgtccagatctaactttaatgaatgtaatcaccattaatcctaactcaaactatttcccccatatttttttttattttaaatcattcttctttacgtctttcttgcttaatttctcctaagaagcaagatttgggttcgattttccttttctaggtgtttttttgtttgtttgtttatttgttttttgtggggacaggactcaagtcttgaaatgtgaaatatatatattcatattatctatattgtgtgtatacatacatatatgtttcacatgtgtagaagatttctctcgtctccaaaaaaaaaggatacacagatacacagtcatgcattgcttaacgatggggataccttctgagaaatgtgttgctatccaaatctgtcattgtgtgaatattacagaatttatttacacagacctggatgacctagcctactaaacacctagactatacggtatagcatattgctcccaggctgcaaagctgtgcagcatgtgactgtactagatgctgtaggcaaatgtaacaatggtaagtatttgtgttatttaaacatattgaaacaaagaaaaagtacagtaaaatacattgttatagtcttatgggaccactatcctatatgtataccattgttgactgagcatcattatgtggtgcgtgactgtctatatccttggtaatatggattactcttaagccattaatccccccagtgtgtactcatggaatggtaactgactatagaattaagcttaacaaatcataattaggaaaacaaatcatccataaaaaatactgtgcacaggcagtttccaagttatgaatatatcaggtccccatagtttacttttcagtcaattgtttagagcctagtcctagagatactatattttggggaaaatgctggttaggtttctgggttccctgtgggtttgatcagcccataatgaaaatgaattatagtagtaatagtaaaagagatcaggattctgggaacaaaagaaaattttactccttattttttattgagtagggctatctgggagaatatttggaaatagtttgctttttatatttttcactctttgcacattttgttaatttacttttattcctctactattgctcagaaagtcccctgagattcctgggattttctgactgcccatcttgcctcactggccaacagcaccatgctccctgtcccaggcgggctcttcttccaaaagtcctatcgacttacaaatcctttttcctcccaaatgcaaatgaagctctcttcatttcatgaagctgatctcatctaaaggttatgatattagccgtggtttttttctaggtgctctgtatcaagtggaggaagctgccttccattcccagtttgtcggtttttatcgtgaagggctgtagaatttcgtcatatactttttctgtgtctattaagatgatcttctgagtttttttctgttgtattgatatgatgtattacattatttgagttttgaatgctgaaccaacctcacatttctgaaataaatcccattaggtcaaggtgaataatcctttttctatgttgcttgattcagtttgctagtgttttgttgaagattttcatgtctatattcataagggatattagtctgcagagttttgttgtttttttccttgagatgtctttgcctggttttgatattagcaaaacgctggcatcatagaataagttaggaagtgttttctctcctctcctattattaagaagactttacaaaggattggtattcattcttcataataaaatttctggaataacttatcagtgaagtcatctgaactatggattttctttatggaaaatgtaaaaattactaattcaattttttaagttgcagtttttaaattagtgattcagtctcttataggtcgatttagattttctctttgtctgataattcgtgtttttctaggaatttgtccatttcatctaagttatctaatttgtgggcacacattattatataatgtttctttataatcctttttatttttgtaagatgggtagtgctgttcactttttcattcctgattttggtaatgtgaatctcatctttcttctttcggtcagtctaactaaagggatgccagctttgttgatgttttcaaataataaattttttgttttattgatttttctcttttgtttttgttttttatttattctgtaataaaataacataataataataattattatttatatttgctttaactttagtttttttcctagcatcttaagatggaagatggttatttatttgagatctttcttcttttttaatgtaggcacttacagctacaaacttccctgtgatcactgctttagctacaatccatacattttggtacgttgtactttaattttcatttctttctaatttcccttgtgacttctgtctttgactcattagttatttaggatgcgttgggtaatttccacatacttgagaatttccccatttttttctgttgttgatttctaatttaattctgttgtggtaagaaaaaataattttttattattttaatttctttgaatttattgaggcttgtctatggactcctatatggtctaccttggaaaatgtttcatgtgtacttcagaagaatattctgttgctgttgggtggaggattctatagatgtctgttagatcttgttagtttatactgttcgagtttttgatttccttgtttatctactgtctagtaattctattcattatggaaagtagggtgctgaaacatttattattgttgaattatccatttctcccttcagttctgtcaattgctgttgttgtattttggggttgcattgttaggtgcagtatagcatatattttcaacttttatcttagatttagggtatacatgtgcaggtttgttacctgggaatattgtgtgatgctgaggtttggggtacaatttatcccatcactaagcatggtacccaatagttactttttcagctcttgcccctcacctctctcccctctccagtagtcaccagtgtccatttttgctatctttatatccatgtgtatccaatatttagctcccagttaaaattgagaacatgtagtatttcattttctgttcccgtgttaatttgcttagggtattggcctttagctgaatccatgttgctgcaaaggacatgattttattcttttttttatagctatgtagtattctgtggtatgtatgtaccacatttcctttatccaatccattgctgatgggcaactaggttgagtccatgtcttcgctattgtaaatagtgttgtgatgaacatatgaacacgtgtctttttagtagaacaatttattttccactggatatatattcagttacgggattgctgggttgaatggtagttccgttttaaattatttgagaaatctccaaactgctttccacagtgactgaaataatttacatttccaccaacagtgtctaagcattctcttttcttttcagtctcaccagcatctgctgtttttggactttttagtaataatcattctgaatggtgtgagatggtatctcattgtggttttgattttcattccctgatgattagtgatgttgaacttttttcgaaagtttgttgaccgtttgtgaatcttcttttgagaagtgtctgttcatgtcttttgacatgaacatttttaatggggttattattattattttctggcttgttcagttgtttaaattccttttagattctgggtattagacctttgtcatatgcatagtttgcaaatattttctcccattctgtaggttatctgtttactctactgatagtttgtatggctgtacagaaactctttaattagttccctcttaccaattttggttttagttgcatctgcttttgagaacttagtcgtaaattctttctcaaggcagaagtccaggatggtgtttcctagcttttattctagaataaaagtctgaaatcttatatttaaatctataatccatctggaattaattttcgtatatggtgaaacataggggtctagtttcatccttttgcaaatggctagccagctattccagcaccatttattgaatagtgagtccttttcccactgcttatttttattgactttgtcaaagatcagatgtctgtagctctgtggctctattactaggttttctattctgttccattggtctatgtgtctgtttttttgccagtaccatgctgttttaattattgtagccttatagtatagtttgaagttgagtaatgtgatgcctctggcttttttttttttttttttttggtttgcttagaattgctttggataattttttttttggttccatatgaattttagaatggttttttgtctaattctgtgaaaatgatattagtttgataggaatagtgttgaatctacagattgttttaatgatattgatacttccaatacatgagcatggaatgtttttccatttgcttgtgacatctgtgatttctttcagcagtattttgtagctctccttgtagagatctttcacctccttggttagctgtattcctagatattttactttattattattttttgtgacaattgtaaatgggattgctttcttgatttggctctctgcttgaatgctactggtgtatagaaatgctactgattttggtacattgattttgtatcctgaaacttcactgaagttgtttaacagtttcaggaggtttttgatgaagtctttagagttttgtaggtataggatcttatcgtcagtgaagagagatagtttgacttcttcttttcctatttagatgtcttttatttcttttttcgtgtctggttgctctgggtatgacttctgcatatatgtttataattgttatattctccttgtggattaaccctgttatctttatgaaatatttcccattatctctagcaatatttttgtttcttagtttatgtatgtcgtctcatatttatatggccactctagctcttttaaggtttctgtttgcatggtatatctttttctatcattttactttcaacctacttgtatatttgaatgtaaaatgtgtcctgtagagagtatatagttgggctttgttatttttccagtctgatagtctctgccttttgattggattgtacatatttaatattttattgtaatacttagatttaatctgtcattgtttttatttgttttgtcattgttttctgtatgtctcatgtttgtttcattcctttcttctttactgccttgtttagtgttaagcaaatattttctagtgtgatatttatttaacttatcttaatgatctttaaataatatatgcattattctcttagtgatgtctctagtgcttaccatgcatgtcttatcaaaatcgacttcagatttatataaaattcattccaacaaaataaagaaattttactcatatatgtgtctattcctttcccctcttttgggtactattaatgttgtgtatattgagctaaatatgttacaaaccaaaaaatacattgttataattttacataatcttatgtttttttttttttaacaaaactgagaaaagaaagaagaggaagtacgtatttatatagtttgctgtattaaccttattatatactgtttacaattcatttctttctgtggatttgaactaccatctagtgtcattttcttcctttctttctttctttctttttttttgagacggagtcttgctctgttgcccaggctggagtgcagtggcgagatctcggctcaccgcaagctctgcctccggggttcacgccatcctcctgcctcagcctccggagtagctgggactacaggcgcctgccacaacgcctggctaatttttttgtatttttagtacagacggggtttcaccgtgttagccaggatggtctcaatttcctgacctcccaaagtgctgggattacaggcgtaagccaccgcgcccagcccatctggtgtcattttcttactgtgatatagttttgctcctaccaaccttctctgcactgtttttgtcaaaaatattaaatttctatatattataaactcactaatataatgatacacatatttttgtgcaatttgtcctttaaatcagtttagagaagaaaggggaatgaatattcaattacactgtctttcttactgacctacatcattacctttattagcactctttcttttctcgtgcagattcaaattattctctggtgtggtttgcttttagtcttaaaaactctctttagtatttcttgtaagggggttaacaaacagcatttgtgtatctcagaatgtttttattttgccttcatttttcaaagataattttggtagattcttgttgaccttttttactttttagcacttcaaatatgtcataccattgcctccaatatttctaataagaagacaattgttaatctttttgagattcccttgcaagtggtgagtcatttctttcttgctgttttctccttctacattttgactataatgtgtccgagcgtgaatttctttgtatttctcctacttggagtttattgagcttcttgactctgtagaaaaatgcttttcatcatatttaggaatttttcagacattgtttccttgaatatttttttctgctcctttctctttctcttctccttctggcacttctattatgcataaactggtacactgaatggtgttccactctattctttcaggcactgtttatttttcctcattcttttttttctcttttggattacataatctctactgatcttcttcaaggtcagtttctttcttctaccagctcagactgtctctcgagaccctttagtcattgttttatttatatttttgtacttttcaaattcagaattttcatttggtacctttaaaaataatttctcttttactggcattttctatttgattagatattgttatcatacattttctttaattctttagacatgatctcattcagttctctgaacttatttaaaatgtgtgatgtcattgtctgctaagtcaattatttaggctccttcaaaagcagtttctattccctgcctttcttctgtctgtgtatctactatgagctgaatatgttatgggatgaagtgtttctccccaaaattcacagattgaagtcctaacctccaatatctcagaatgtgactgtatttggagacagggcctttcaaagaggtaattaggtaaaatgaggtcatatgagtgggccctaatggaataccactggtgtccttccaaaaagaggagattagatacacacacaaagggaagatcacgtgaagacagcatgtgaagaccacgtggagggaggtggccatctacaagttaaggagagagggctcaaaagaaaccaacactgcttacatcttgatcttagacttctagcatccagaattttgagaaaataaatttctattgtttaagccacatagtctgtagtactttgttatggtgtccctagcaaattaatacagggtcacattttcctatttctttgcatgtcttgtaattgtttcattgaaaactggaacttttgcataatacattgtagcaacactgcttattgattgcccctcctccaccccagggggttgatgttgttgtcttggccaatttatttacgctttgatgacttaaactctatttcccacacagtgtgcagcctcgtgtttatatctttgagcctggctatgtagagatttctccgggtcagcataaaatcactggtcatagattgtgcttaagaccgcttagccagttctacttttactctttaccttggatgtgtttgtggcttggaggctgctattgcaatttaaataattatgtgtttgccttcacattttgtgacggactactagcttggatttttcttctcccatcactctggagaaggcacagtcttgggtgtgtacagggactttcaggctgccagggatcagcatggtttttcttcttaagcctgctttcctaggagttgcctctgggtcagttcagccagctgtggtgaagtttgtgcttaagcctctagtgccagtgaggcttctgccctttgtggattattccgtatgtggtttagtggtgttttcaaatctgcccacatctagctctgattgcttctgactattgctaggtacagccttgcactgcacacagccttcatgaccgccagggttatgtggcatcccaggagggttcttcttggtggtctttccattgtaccctgttacacttctgattgctctgccattttgcatgtggtagcttgcaccatggagctatgagtgccttctgaattgctctccaacaagatgctcattgcttttgacaatgtccttaagcatggaattctccacgctccattccaaataaagccagcccctgcaggccgagctgtggagttcttcgtccctgagatctgcctctttggcctgcctcttcctgagcagcacttctgttccactgcacaagagctgggggtagaacccactcttgtcccagagtgacatcctgctccgccagcaggtacggagtgtgtgtggcctgtaccttcctggcttgcctttccttgtatggagcctcagccttagaagtgagctgggatgaaggtgatcagggcctcactattctctcctagctatgcctggggaaaagcttcagtcctacgaatagaagttaggtggaggaaaggaatcctgggcctcttagtcacccccgcctacaatggaatttctgtaaaatggggctggaagatgagaaactctgtcagcccattcctcccatggtgaaactgtagccccaggctggggagctggggagctggggtggtggtgggaagagtctcattttcttggttgcatctccctggattagagctcctcaatcagtttccctaagcttggggtggaaggtaagggtcatgactgaaatgccacagacccctgtcttaatgagatttagctgattttctcattttcttgaatgaatattaccctatttactttaggataattctctttaaaaaactatgtttttaaaaaatgctttcctcctgataaatggatgtttactggggagagattctgagggactcttcactcttctctggagtcatctttccctttgcgttataaataattcaaataacacaaataacgactcctacctttgggtatacattttttcacaacgaaaattttctcttctattacttctctatatgttttatatactaatacccttatctcagtattttattttattttttttgagatggggtctcactttgtggtccaggctagagtgcagtggcatgatcacagtacactatagcctcgaacttctgggctcaagtgatcctcccgcctcagcctcccctgcagctgggactataggcatgtgccaccatgtctggttaattttccttttctttttgtagagatgggttctcactatgtctcacgggctcttcttgaactcctgggctcaggcaatcctccctcctcagccttccaaagtgctgggattacaggtgtgagccactgcactcagcctatctcagtattttaaataacagagccaccaataattagtgcactgcaggacagagcaaagagctaatcctcactcagatcgatctgcatttgaacagcactctattgtttcacaatgctattgaaatgataatagcactttgtcctcattgggaagtgactggaatgtgtttagcaatacggaatacggtgaggatgacagccgaaggcacacaggttgttctggcagagctaggactagaatcagggctccagacttccaactcttccaagctaaaaagagtgaattagacaaaagcactctttaaaaaaaaatctgcttattttatgtctggagtaggagcttatctacccacaaagatgtggatcactattaatctggaaattttctgtttctatattttaatttagtaacaatgcgatgaaacttgtgcttttgataagatttcctatgaaatgagacatcatttggatacataaatattctcactggcaaaattacttgacataggcacctatttatttgatacaatgactgaattttaagtatctctttgaggtttaaaaaaagccattgaaagtgaaaaagagaaacaaccttttaacagcagagggggctggctgaattaataaaagggactgctgaattacaatttatcatttaactgaaggattcttttcaatacaatcactactttgaaaatgaatatttattatgactgaaaattagtgaagattaattataatgctatttattaggagacctttaaaaaccatcccttgtttgaaaaacacttataaagctcctagttgttcagacatttatgttagcaactgttaaaaaaagcagtgagctgctactaaatatatcagagtgcccaattaaatttctacaggtcatcagatggcgtcactgactggtggaaaggctgaagttaaatccttcatcctaaaggaaacaatcagacaacatgagttctgtatctaatccgcagcatgacagaaagccaataggaaaaagtgaattgcacatcactcgtggcttttcataaccattgtccacagtttgatcttgatgtgaaccactgagacatagcttgtaatcataaaatctgcaatgtcagtgaagcaatgatagacaggtaagaacgagattggtgctcaaagcagctagggaggtctataggtttcgcctgacaagagaacagatcaaaatatggcagagtaattgcccaccatttccactgtttctttttcttctaaattaaaagtactcagtcatgcaaacaaaccgattgtaatgtctgcctttccttctttccttccttcccttccttcccttctccctccctccgtcctgccatcctcctccctttctctttctctctctccctctccctccctccttctctcctctttctttttctttcttttattaattcaccaaatatttaccgaatgcctacagtaggctaggcacttcgttactaggctagatactgggctaggctagctacagggatatagcagagaacaaggtagacacagaccctgttctcagtacccacattctcatggtggtggttggaggaggtgggcacagacagtgaatgcataaacaaatgcaagatgagttctggttatggtggctgttaggcaagacggacactggttcacgtgacagaacttgtctagagtgggggtgcaagttggggtgtgtgaggtgggatagagattgggccatgccagttaggccattaggaaagacctgttttaagacctgagagtgagaaggaactgactgtgagaagaacattccagacagaggaaacagcaagagcagaatccctgagacaggaaagggtgtgcaggaactcaaggatagattgatgtagaggaggtaatgctgtggaagtcaggatgggcaagaggatgaagggacaaagcatctttggttggccagactttatgtaggcttctgaaccttctcctaggcccatccaggcacttccttgtaaaatctacttttagcaaagaaccctgctaagtcactttggcaagaacccctcaccccccgtcctcaacatctgatcactctcgattctgatcaggttcctcatcctccaccatcccccaggtgatgtctggttatcctggcctgccttcatcaagaatcctgttaggtcaatttagccagaatcccccttactcctgatgtttcttcctagcaatttcccatccactgacccctaccctgccccttgactgctaattcccacttgctcatgccatactcagagttgtgcccaatctctctcccctactgcaagaccctgttgcagtggtccctgtacccatcgtgatagtcctgaataaaattttccttatcatgctttaacaagtaccattgaataattttttctttaacagtaggaatataatgatgaccaacatttactgagagtttgctgtgtgtcagctcctctaagaaactaacatgtattatctcatttaatacccatgacaaacttagaaagtaggtattagtattatcttctttttaaaggtgaggaaactaaatcctaagtcaggcaaaactgggagttgaaccaaggttgtctgactccagcatctgtgagtttaaatactatgctttagtattagagggaatgcaatcatgtggaagtgagcaggctagacaagggctctatcatgatccaaaaatatgtatggcaaaccctatgcctgtgatggtgtagtagcagctccatagagaaagttgcatagacacaacctttgctttcagtgtatttataaccaggaaaagacaaatgttatagcaggaggggttataggaggggaaaaatattaaaccaaaaagcaaatgcatggttacagttcagtcatcacatgcaggcgaaaacttaaatgatagttcactttagtccttagctaagtagttgtgtccatttcagactgaaatcttattctgtaattcccaagaaaggccttttccgccacgattactgtgttttcgctttcttattttgagggggtgatgcgggagaaatacatgaagctattgttccagaacaggttagtcatgaggtctaacctcaagctggcaagtccctgtggaactgtagtgaaaatgtttttacgttttttgcactgttaggactttctaaactaattgtactaaattctaggacctgagctaaaaggcaagcctgccagttaaatgatgattgattagatggtaagagaccatccagagagatctacctccctggaggtaagtatttgtattttcatttcaaggggagaatgagacctgagaccatggagacatcctaaggttgtaaagctggagaggcgagactttgtctactccttggagagatttatttgcattccaaaggctaagaataggaactcaggatccttgccaaagagcaaaggttctcccttctctttcaggagggaaggggagatggctgtccctctcctatataactacccaggttcatctttgggggatttcttgcctacagtggaccctatttgcttctcactccattgccccaagggtaagaactggggctaaagggatctggagtggaaattattgtataagtagtgataattaatctgttctgcttcagaaaccttgtgtttgcattcagggtagtattagtaaatatagaattggaaacttagtatccttccagctctttctccctcatgggcatcaacggacaagatgggaggagggaagcaccagcctatgtaggtgggtggtgggaaggaggggtggagtcaggggagttttagtgaccagggagcctggactctgggccagttcacttcctgcattccaggtgcaggaaaggagaaagggggatcagtttgactgctaagttaaatgtaggccgaggaaactgtttccagtaggtagaactgggacaatatacactctcagggccataggagaccctccataattacatgcataaggatgcacagaggagagggagggaggaagaaaggaagggcccaataaagtctactcgtggaaatatactcggactgtgggacagaaacaatgttcaggaacataaaaagtgaccatcttaagtaatgcttacctaatatgactaaatgaccctacatgcccagctgggcagaacaattagaaatgctgatctactcttcaatcaagagggaagtcactggagctgctgaacgaacagagcataacccatgagttgtggaaactgcaatggaacggcgccagcaattgccctgcgaatacaaaaagcggagggccctcctctcccttcctcagggtcttaatctacactcaacttctcagggactttgggcaaaacagaatactgtttataaggcgggtttctggtaacaatgtgtgggttggttttgcccctggaggggttaaaatgcactattctggcatattcaccatttaagtcaatgccacatgaacatcagcaggtgtgaaaagatcactctgagattcttggtgtttcttaaaagcagaaggtgaaattcccatgttaaagatgcgctcctagaggaagcaatattcttatcatcaaggatggaaagtcaatcgcaagagaattctgaacagatattgctgaactaactcctgtccactaaggctccccacataatttggttgttttcttcacaactgactgctctttgtccaatctgacatatgagtatctgacattgcttcttggggtcttcatttcttcctgagagctcctgtgccaagaaaaacttgtaatatgctttctcctatgaatctatgttatgtcaatttcactctcaaactcagccaggaccctagaaggatggaggtggaatttctccacccctacacctccaaaatgaatattaccagaatttaatattattgggaaaaaatgttcgaataatcctcatgcctctaaaagtcattatatctctcaccaactgtaaatagcttagaatgttgaattttggagtagatgaagaaagaaagatctcagcagtttgggctcagaatctagacacataatgacaggccagggcctctggctcgtaagatacggaacagctttggcctcaagcagagcttgggtctccactgacactatcagctcaatttgaaacaatggccttgttttcagaaatccttcaccataaaatattttgctatttcattagtcaccattaaaagtgttaaaaatgattcattcaatactttgtattttctattaaggaggaataaaagtattgactcattcaatactttttattttcctattaaggaggaaggtttacatgcttggtgttttctctccagggttcagagttcatgagaatcacattctcttgatatgggctatttcctagcctgaaacagagaaaggccatgcatacatcccaggattttagccattgttaccagcagtagaaactttgacaggccttcctggagaccatccaccactagccagagttcatgggcaagactaggtaccccggaatcagggcctcgagcatggcaagcaagcatggggtccaggttggtgggcaaatgtcatagcctcagtatgacaatggccagcaaaggccagtgatagagttggatgaagcttaggtatcagtatataggagcaaggcaaggggtcacttattgtagacttagtgcatagaaacatttaaaaagcacagtaccaggcattatgccaggcactgggaggcacacagatgagtgaagaggggtgcttatgggtgatggatatgtaaatggacaattacaatacacagcagtgcatatgtttgaaatgtgcacaggtcatcatgagggcacagtgaaagggcctccagcccagcctagcagtaggaagtgggggggctacaggaggaggccagagaaggctccctggagaatggatgcctgagctgagtcataacagatgcagagcaattcaccagacaaaggagagaagcattcccatcattagggacaacaggctggcctcacattgtgttgctgtggattgcagactcaagcaatattggcaaaaagccccagactcagtgtctatctgtgtagacatagggctggaatagtggagactcaagaggcaggtctgcatgagacatggtcagggccagggaagtgtggtaaccccaggaaggctgagctgtgcacttaaaacaaacaaacaaaaacaaacaaacgaaaaacaaaaacaaatccaggaaggtgtgtattaggacaaagggcacaaactctaatcacaggggaaagtaacggacgttgaagaaactagattgaagttgacaaagcagtgaaactagatacacctggacctgtttcttggccagagatttactgtttttatgtcttggtctcaggccaaaaatttgtcctaaaattagagcagggcactgggttcacaggtggctgctacgaacatttccagggccagagtgactggagccacaggaacagggaatcacagagaaacaaaaaactaagggcacaagccgcagtgggtgagacttgatgagcaaggcagttttctgacctagttcaggcttcccctttactttcctgtgtggcaggaatcaatcccagcacagctggactcaggctcatagatggaagcttgcaatttgaagcacctggccaaggcagcctgcaccgagcagggacacagctgtagctttttgtaagtgagtcctctcatgggtaggggtagggggatcacattaaaaaataaataaaagctactgcaaagatggatatagcagacctctctatattattaaacactttgtctcagagctgattttatattgcccttaagtgcagagatagcaatagtcaactcagcagtgcaccaactcattcgctcaaaattacaaagggacaacttctaagatcacatctctcaggaaaatacaaagcttgtttgccatctagcccgaattaacctgttcaatatcatgcacaaatgcacagtttaaaatacttgcccagcacatttttaaacatctctatacctatttgctttatatcgttgtataaatggagtatgcatacatgtgtgtatgtgtcacatatacacacatacagggtaaatatatgtttatatgcaggtagatatattagccctgcatttatagttctaaagaaatgagaatgctttttttcttggaagaaccctttagaaatttataggtgcttagcatcataaaatggcttttcccctgacctgccacaagtctgtggtgcaacctcacagcagcaatctcattactctaacagtggttacatatggtgcttcaagatttttatttttaaatcacagaaacccaaaaacgtagatatcaaagacacttttcaaaggcaacttctaaaaaggataaaacctcttcagacagctgtcccagattaatgaaacctttctccctcaagggaaatgagaacatcctacaggaaatagcaaaaggtggcatgacagtatctccagaagatgaatttccttcacttcatttatagcactaacccttcagttctgccttaagatcagatttgcataatcatattttgtatccctgatcatttggcttatgacactgtaatatcagttgaaaatttccaagaataactatatcatttcagaagaggaactggaagcagccaccagagttgaacctgtaagcaaggtggcagttctgaacatcagcaggagctactatgcatgatttgagattattcaaaagccagcatgcaccttcacacccttctcaaagtagggtgtggtaccggctggctgagaaaatagattagcagtcaataatacacttttaaaagaataactatttttccaaaggggaaaaaacatgatttagtctcttttttccaccctatcagggtattgactacttgcattttttggtaatcattagtcattttactgcaaaaatgaagaggtacaaaaatacaatgtaggaaagagagaagagaaaagaaaaggaagatttcaaattcagaagaatacatctggaagcatttatttagttgatccattgatgaaagaaaaaagtcaattgatttcacaaggcaaaattggggctactttactagtgtatttcccagcagttgacttgataatgatttttcaaaataaaatatattatctgaaaaacataactcagcataattgtaagaatcatacatttgctacaaaatagaaaaacatactaaaatactattttattgctaatttgtcatctaatgtaatggtgaattaagacctcagaaaataaggcctgaaacacaggaaatttaaaaatatttgtcccaggtatgccacaaactgtgtgaagctttcatatgtaatttcttggcttattcaattaaattatccaatcactgtgaaaagaaacacatgtaaaacattcattttacatggttcaacactatgcaacaggttcatgtgtcaaaagaaatcactgactacaatagtccacagtaagactgagctttttcaaaaagcattttgagtttgacataaatcttgttttttatgggatatttcttcctttgttagttacacaatatttcccctcaataacagcactaagttcagtaacagcattctatgtcactagagaaaatcatggttggtccttcatatctgtgggttcaacatccgtggatacaatcaactaccaattaaaaacattcaggaaaaaaattgcatctgtactgaccagatacagacttttttttcttgttattattctctaaacaatacagtataacaattacttacataagatttacattgtactatgtactataagtaatctagagatgatttaaagtataccggggggatgtgagtaggctatatgcaaatactacatcattttatacaagagacttgagcatctgtggattttgggatccaaggccatgcttgttgccaattcccctctgataccaaggaatgactgcatgtatctcctgcaactgctgattccacacgtgaaaatgtgattatattacttgacatttatgtgtcactttttgttttctaaatgctttacaatttcctatgggattcaaatgagcagaaaagaaagcccccagtacacaggaaggcatgaaccatggaaacatctccaactgctaagttcctacagagagacacgggtccttacaaagtaatactggcctgaagaagcaggaccaaggagcatgctatcagcgaggatccaagttaataccccagacctccaaggctggaccacatttaccaatggagagaaaaatacatgcccaagatgagagtgaacgacagaagccaacacaagatctcctgactttccatatgacattttgcatcactgaagattacgctactctgaagaccttgactgaacaactaactgctggtaaacaccggcattttttttttaacttgtagttttcctgaaatgcctggaaattttccttctaaaggttgtgctcagtattcgagaataagttaaggctaagttcataacaataacaaaggctatagagtgaacagaagtttttttggtttggtaaggaagggaggggcaaggggcatttgcagtcaaaggccatctataagtacaattgtattatttacacctaattattaaaatcataatagaggggctaccgaaatgtgacagctaaattagtgctcactgcatgaagcacaagaaaataaaagaatccttttgataaattccacagagagaaaaactaacgtaatgatatttggcaatgaagacgggtagcacctttaaagattaagagaaacccataaggagcttccaatttccaatctaaattcaagtattacacacacatataatagtttgggcaagcatatggctgtccggactacactatggtaatgcagtatctcagcattgtcttttcattaaaaattgtattgggccacatcaggcagctcctctatctttccttcatcatgaaggagagggtgggaaatcgtggtgcgtcatagaatgaaacttgtcagaagcactggttcatcatcctcacaggccaatctgctttcttgtagatatgtgcttttctaagactacaaggaacactgcgacttttcctgaggctttgggttactggaagatgaggaaggataaatgtgaagttgtggactgttttaaattccacctgaccattctgctttcctgagcaacctacccacgccaatttagtactggctttcttcagagcattaggacaatgggattctgtctacagctgtgccatgaacggactctgattccttaggcaaagaatctcttcttgctaaaatagttaatttgaaggaataacaggaatatataaaataatgtctcaaagtgttttggtcacctggtaaagaactagatttcacatgaatgcaacataatcagtactatccttagctattgatgacatatctaaatgggacattctgggcattgtccggagcatgctgaacagaagcattatattttcttagaaaaacttaatggtgccctcatttgaccagcttttcaccatgtccaaaccttccagaacattgtgatttaaatgatcatagtctgttcaatttcactgcaagaacatcattacatgttttattataagaacattaaatattttccttccgtgttggtttttcaagctgttcttgttctagagtaaaagtttcatgtactctaacaaaaccttttcagttatacagacaggtaactatctcctatttcccaaattttcagaatgagtaaattccagaggcactgatgataccaatatactcatattacctcaagtgaagaaagaaaggaacacacgaacacagatagtacctggaatagtgattatttaatagtaagtgatggattagtaagtgaatgtgtaagtgacatcagcaaaattgagtgaagatcccagtgacatctagatgtgattagaaactcttaccatttcaacacttgtaagttcaggacattcatttattttatatttatttattgaatcacttgtcatttatgtgccactttctgttttctaaatgctttacaatattagaatctaggaagacagtggtgaggaagacagattcagtccttgttcttgtgaagtttacattccagtagaaggggcaggaccacaccctcccatcgcacacacatacacacagaacatgaacacggaccacaagagagcggcacattgcgactaatgtcagggtcatcacagagaaagagccgagggagccgttacaggtaagggaaggctgttctgagaaggtgacattttggcaaagatcttttaatggaggacagaggaggcaggaaaacaaccagagaatgcctagcaagaagttggcctgttgcaaaaactgtgagaaaatcatccactctgattggcgaggatgtggccagcagggggaattgcaggaaaatatgacaaggatttacccaagaagggactatttgcatataattgtattaaaaaaaccagagccataaacacatgtaatattgataaacaatgtcttttatgatcacaaacagcattacagtgtcttttttttcagaaatatattatgcaactatttatatcccaagataactgcagacattcagacattcacagaaagaaacaaagaccgttattgtctccagtttatgagcttcaggaaaaaaacgtgggcgtgtgtgtgtgtgtgcgtgcaagcacgtgtaagagagagagcaagaacagttaattactaaacattagaagaaagtcaaaccatgtgtgggctcatgtcattcaggccatcacaatcattttattccacatgacaaatggaataagaaatagtgatatttaaaagtaaaacatgcgaagaactgtaatactttaaagcacaggttagaaagctttttctcaaagggccagagagtaaatggctctaagggccatacttcctctgttgccagtaccctacttggcttttctagaacaaaagcagccacagacaatacataagagaacaggtgtggctgtgtctcagtaaagctttatttacagtaacaggagatgggccagatttgatccacgagatgaggtccgctgactcctgctttagaggactagaggacaatgctcaataatatctagaagaatcactccaaaatatcaagccaatttctcaaacgtgggcaagagaaagagccaggaaagggtgacaagaaactgctggattggattagctagaggttatcgtattttactagccataggcacaaatttaagtgatagcgtaaagaaatctataactgtttctattgactgtgcaaatgttaaaagaacattgtcaaagatcttatttttaaaatgttgtatgaatgcttctggcatgaggtacgcagctggcacagatgattccaaagttcccatccaactctaaaattctaagtttccaaaatttaaattataatacaattactagtatctggcagaatttcaaaagcggttgaaatggtgttttatgacttttttttttcctggcttaacatttttgtaaattctagaatgctaattcttgaagcttggcagctaaaacaataattgactatttcctagtcactttgcaattggtttcttttaattgaggatgaattggtacagcatgtaaaatctgaaaactaaaaatggatgctttagacaattcattcttttcactgaaatgattcaaccatactaagccatatatctacttttatatatcatttagtgaagaccctgactaagcactcacattgtataatcactaagtacacattcattgaccatctattacagggtaaattcatgattggcctatattagggcataaaacgcttattaattgagtgaatgaacataaactctaaactatggtgtctatgggttcaaattatagctctgccactttctagctgtgtgaccctaggggaaattacttaacctttctgtgtctttcttggtcattggtaaaatggggagaaaataatacctatattataaggtattgtgagaataaaagttgacaaccctatttccacctgcactttcattctgccaggtacaatagttgtctaacatataagcatcatatcatcctacaaaagaaatggtcttccaagagagcctggtgtcctgctgatttctggcaaaagagttcccacttaaaattctactctaaagtatcgtattcaaaatgaaaagaggaaaacaacagaaaatgaaaatctgttaaaggaatcaagtaatttcatttgctgcgtgccatacatgttgctgggtattacgaaagcttcaaaagcataattcctgttatccaggagctttaataaaataaaacatactaacaggtaaaggtaattaaatgtacttgttacacatttattgagcatttgcaagttaccagcattggtaatgcaaggatacttcagatacaatctagagaggcaagtcacatcaactctgtgagacttactttcttcatctttgaaatgggggtagaactgtttcagcaagattttgtgagaatcactgcacaacgggctgcaacatgacaggcttgcaacaccctaagcgctttgagtagaggctgcatgagtgtggaggagagactcagcctcccccaggaaggtgacaatagagaagtgccttgaaggaggtttgggagacagagaaatccagtaagaacatgccatgaggagagcacagcacatgctaagtcaagggcttccaacagggctcatgagtgccaacgattcactgccccaacaccagaggtacaagggttgcctcagattcaagtccatctaatccattcaccatttgcctatcagaactatttagtaaaataaaatctgatcatgtgcctgtttctccagtccctgcttaaaagccttgaataaatgttggtccattgggtgaaattaatgggatcttttacaaccctgatcctaatttacccagctttatctcctggagtctggtcaccatcgtctcttttatacatggccacaggaagtattatgccacagtggctaagggctctggttttggagttagacacacttttctacttagttgcttgggtgagttattcagactctctagagatcaatttgctcatttgcaaagtgtaaaatgggttataggaattaaatgaaatagcacacttagcatagtgtctggtacggaaggattcaacaaatactattaaaaacatgtcagaaacagtattttgggcttgcttgcaaaatggaattttggagtgaagttcgtgggtgaggcactaacagtgaggtcctgcgtgaggatggtggctggtcgagaggatgttaggaaggcagggatttaaaaggacttggggaaaaacaaccaagacctagtgagaggctggacaagtagaggagaaagaataaatcgaggatgacccaaagattttgacattgagataatagtggtcctaaaaaaaaaaggagaagtcaggtaggtgagatgggatgattgaatttataatttcatgatgcataattatacaaatttataaaatagatgccatattcaaaagatagaaatttctagatttaaaattatgacattaccatgttaacgaaatttcctagtctgaatcctgttaacattattaatacttttagccttcatgccaagaaacacccgtgttctcctgtctctctttgcatcctccccagctaattccttcttctcctgccccctaaagaacagccttccctggatttcaagccacaatccttctctttttctattaactgcctccctggggcgggaggttggggggacttggttaatcttactcttaagattctattggactttaggtctccagtttacctgcaccttcccctatattcaaactaggcagaattttccatacctagaaataaatttgagtgaaaaataatgataatacaaatgtcagtaacaaagcaggaatttcaaagtcgaggcagagataattcattcaagcttttaataccaatgcatatgttatttaccagtaatttttcttaaataaaaatggatcaaaatgtgagaaaccctccttgtgtccctcaggaaatgttttctcatgtgtaacatttagagcttgttgattcccaaaggagattaaaatgcccagttaaaccccacaataaatattaggttgaaacatttgaatttcttattaccgaagacccaggaagccttttattaggaaagctgccttgccaggacatgattttttttccccaggggacataattaaagagggcgatactgctgagagcatgtgcaccaacacgctgtatttgtcaacacacacaatgccttcctagagaggaaaagcagcccagctgttctacagtggatcttccaagaatgtattcaggctcaacaccaaaaccgccaccaagaaaatgcaaaaagccccacagaattttacataggaatttgaatagtgtggccggaaactgaaacacagtagaaactaccagcagagtacgtagtgtttgatctccaaactctctctgactataaccatatgacaaattgggcattaaaatattacggttaatgtggtacttcattcaagaaatgtattcaagtttatcacaggtaaggggtgaaggagatttcatagatgactcccaggttcctaacttatgcaactgggtgggtgggtagaggtgccatagactgagacagcaaacagtagaagaggggggagcagatgaaagggggtgtttttgtgttgttttggaaataaagggtttgatgtgaccaggaagtactagtagatgccctcctatttaatacataggccctaaacatggtcaataagtcaggtctgagttatgaatgggaattaatttaaggcagtaattcagactatgtaattcttgctttgcctttgctatttaaacatttagtaactgcttaaatcttctaacttttggcttgaattattttcttctaagtttagcttgatagtgttattcattttatctaactatatttttgcacccattaactatctctcatcctccactccccactacacttcccagccactggtaaccattgttctactctctatctccattagttcagttgtcttaatctatagttcccacaaataagtgagaatatgtgaagtttgtgtttctgtgcttggcttatttcacttaacacaatgacctccagttctatccatgttgttgtaaatgagagaatctgattctttttttttttttttttacggctgaatagtattccataatgtatacctaccacattttcttttattattattcttcttattattttttattattatactttaagttctagggtacatgtgcacaacatgcaggtttgttacatatgtatacctgtgccatgttggtgtgctgcacccattaactggtcatttacattaggtatatctcctaatgctatccctccccctccccccacctcatgacaggcccgatgtgtgatgttccccatcctgtgtcgaagtgttctcattgttcaatgtccacctatgagtgagaacatgcgacataccacattttctttatccgtttgtctgttgatggacaattaggtagattccaaatcttggttattgtgagtagtgctgcaaaaaacttgagagtgcagacaactcttcaatatactgatttattttcttttggatatatacctagcagtgagattgtgggattgtatgatagctctattttcagttttttgaagaacctccaaactgttctccacagtggttgtacgaatgtacattccctccagcactggtttcccttttccccacatcctcaccagcatttgttattatctgtcttttggataaaagcagttttaactagggtaagatggtatctcattatagctttgatttgcatttctctaatgatcaatgatggtgagcaccttctcatatatctgtttggtatttgtatgtcttgttttaagaagtgtctattcagatattttgcatatttttaaattgcattattagatattttcctatagatttgcttgagctccttatatattcttgttattaattccttgtccaatggatagttgcaaacattttctcccattctgtgggttgtctcttcactttgttgattgtctcctttgctgtacagcagctttttaacttgatatgtcctattttttcatttttgctttggttacctgtatttgtggcatattacacaagaaatatttgctcagcccaatattctagagagtttccccaagcttttcgcagtagctttatagtttgaggtcttatatttcagtttttattcaattttgatgtggtttttttattatactttaagttttagggtacatgtgcacaacgtgcaggttagttacatatgtatacatgtgccatgttggtgtgctgcacccattaactcgtcatttaacattaggtatatctcctaatgctatccctccccccttcccccactccacaacaggccccagtgtgtgatgttccccttcctgtgtccatgtgttctcattgttgaattcccacctatgagtgagaacatgcggtgtttggtttttcgtccttgcgatagtttgctgagaatgatggtttccagtttcatccatgtacctacaaaggacatgaactcatcattttttatggctgcatagtattccatggtgtatatgtgccacattttcttaatccagtctttgtatatgccaagaggtaggggtcttgttttattcttctgcatatggatatccagttttcccagcaccatttattgaagagactgttctatctccaatatatgttcttggtacctttgttttaaggtatgaattcactgttgataagtggatttgttttgtgggttccccattctgttccattggtctatgtgtctgtttttatgccagtaaaatgctgttttggttactgtagctttgttgtaaaatttgaagtcaggtaatgtgattcctccagctttgttctttttgctcaagacagctttggtattctgggtcttttgtgatttcatataaattttaggattgtttcttctatttctgtgaagaatatctttggtattttgataaggattgcactgagtccgtagattgctttggatagtatggacattttaataatgttgattcttccatcctatgaacatggaatattcttgcattgttttgtattctcctaaattctttcatcagtgttttataggtttcatcatagagatctaaaaattcattggttatttcctaggtgtttactgtcacttgcaacagggattacttttctgatttctttttcagattgtttgctgttggcatatagaaatgctacggattttttatgttgattttgtaccctgcaacgttactgaatttatcagttgtaatagttttttggaggagtctttaggctttcccacatataagatcatatgatctgcaaacatagataatttgacttctttctttccaatttggatgtcctttatttccttctcttgtctgactgctttagctaggacttccagtaatatgttgaataacggtggtgaaaagtgggcatcctattcttgcttcagatcttaaaggaaaggcttttcctttttcctcattcagtataatactaggtgtgggtctgtcgtacacaccttttattgtgttgaggtatgttccttctacacccacttttttgaaggtttttcttttttaatcgcaaagtgatgttagattttatcaaaagctttttcagcatcagttgaaatgatcataaggtttttgtccttaattctctttatattaagacactatttgggcaaatatttctattgatatgttgactgattcatctgcatatgttgaagcatccctggaataaatctcactcagtcatgataaatgatctttttcatgtttttgagtttggattgctagcatttcagtgaggatttttgtattagtatttataagggatattgaccagtagtttccttttctttgatgtgtccttgtctggttttggtatcagagtaatactggccttgtagaatgaatttagacatatttgttcttcctctatttttcagcagagtttcagtaagattggtattagttcttctttgtatgtttgttaaaattcatcagtgaaaccactgggtcttgggcttttcatttctaggagaatttttattacagctttgatctcattagttgttattggtctggttcaggttttgaaattcttcatggttcaatattagtaggttgtatgtgtctagaaatgtatccatgtcttctaggttttccaatttattgacatacagttgctcatagtagtctctaacgatcctttaaatttctgctgtattggttgtaatgtatttttccatctctgattctatttatttgggtcttctctcttttattcttagtctagctaaatgtttattgattttgtttatatttttataaaagcaactttcctttcattggtattttgtattgttttgtttcaatttatttctgctttgatctttattatttcttttcttatactaatcttgggtttggtttgctctcacttttctagttttttaagctgcatcattaggttatttgtagttttttctactttttaatgtaggcatttatagctataaactttccttttagcgctgctttcgctgtatcacataggctttcatacgttgtgtttccattatcatttgtttcacgacatatttaaattttcttctcaatttcttcatgacccactggtcattcgggggcatatattggaatttacatgtctttgcatagtttccaaagttcctcgttattgatttctagttttacgcaactgtggtgagaggatacttgatataatttcaattttcttgatgttttaagacttgctttgtggcttaacaaatggtctatccttgataatgatccatgtgctgaggaggagaatgtttattctgccagccattggatgaaatgttctataaatatctattaggtccaattagtctacacaacagattaagtccaatgtttctttgtagattttctgtctgaatgatctgtccaatgctgaaagtggggtgctgaaatctccagttattattttattggattccatctctctctttaataatatttactttatacatgggtgctccagtgttgggtgtaagtgtatttataatcattacatcctcttgctgaattgaaccctttatgattaaataataaccttctttatttctttttagagctttttgtcttgaaagctattttgatataactatagctactcctgtacttttttagattccatttgcatggaatatcttttcccatccctttattttagtctatgtgtgtctttagaggtgaaatattttcttagtaggcaacagataatgggtcttgtcttttatccattcagccactctgtcttttgactggcaagttaaatccatttactttcaatgttattattgataagtaaggacttactcttgccattttgttacctgtgttctgggtgttttgtgatcatttcttgcttctttctttttttcctgtcttcctttcagtgaaggtgaatttctctggtgttattttttattttttaatttcttgctttttattttgtgtatttgttgtatgctttttgttttgaggttaccatgaggcttgcaaatatcttgtaacccattattttaaactgatgacaacttaacactgattgtataaacaaagaatcttacaaataagcaaagagaaaatgaataaaaactctacactttaactttgtccccccacttttaaattttcttgtttctatttatatcttattctactgtctatatcttgaaaagttgttgtagtggttattttttgattggttcatctcttagtctttctagtcaagatacgaatagtttatacaccacaatttacaacaccacagtgttgtaatattctgtgtttttctgtgtacttacttttactggtgagttttgcaccttcaggtgatttattgttgctcatcaaagtccttttcttttggattaaagtactccctttagcatttcttgtaagacaggtctggtgataaaatcctttgtcttctgttgttctcgaaaagtatttctccttcatatttgaaggatatttttgctggacatattattctagaataaaaatatttttccttcagcactttaaatatgtcatgccactctctcctggcctataaggtttccactgagaagtctgctgccagatatattggagatccattgcatgttatttgtttttttctcttggggcttttaggatcctttcattatccttgacctttggaagtttgactactaaaggtcttgaggtagtcttctttggattaaatctgcttggtgttctatatgcttcttgtactcgaatatttatacctttctctatgtttgggaagttctctgttattatccctttgaataaactttcgaccttgatttctatatctgtcttctctttaaggctgataactcttagattttcttttttgaggctattttctagatcttgtaggtatacttcattcttttttattcagtttttcccaagatttcaaatgaataatttattaggtgaaaataaggttacagagactaagtaggcacaccaaagatggctaataaggacatgtagaagttctgaaaatgatctgagataacctttgaaaatgaatttgtttatagcccaaacctactactttagaaaaccctggaaaacagaagaatacacaagcatgcattccacttttacatgacatcattccatgtcatgtagcctctggaaaactccactaggtgctcattaagtatgaaagttttggcaaatgaagtcttaaagtcttaatattataaaaacagttttgaccttctggactccctgaaaaatcttggagatctccatgaaaccatactttgagtactggtatcaccacacttttaggtgtttaaacatcacctgcattcatttttcttttgtcctttctgactgtctattttcaaatagcctgtcctcaatctcactaattctttcttctgcttgatcaattctgctggtaagagactctgatgcattcttcagtatgtcaattgcacttttcaactccagaatttctgtttgattctcttttaatgatttcagtctctttgttaaatgtatctgatggtattctaaattccttctctgttttatcttgaaatttgttgagtttcctcaaaacagctattttgaattctctgtttgaaaggtcacatatctctgtatctctaggattggtccctggtgacttatttagttcattcagtgctgtcatgtattcctggatggtcttgatgtttgtggttgttccttggtgtctgagcattgaagaattaagtacttattgtagtcttcacagtccttttttaaaataattcttgtcaagttgcatctttttattgcatagtcaaatgttgtccttggacattcttaccatttaaacaaatactcaaaaattgtaagtcataataaactctattatactattgtaatctgttttctaaggaaattattctatcatccaaaaataacatttatgcttctttcagagagtagttaaaatgttattttattaaaaatgccaatattagtaataatggcccatgaagaaataactcttctattgtgaaggcctgggtagtccaattaacaacattaccacccaacacaatatatctacatatctatatctgtctgtatctcataaggcttgagacagcctcatctgtaagattctcatcttgatagtgataggtctctgagacatgaaaaataaacacgtattccacaaatagattttagtatcttacagatgtctgaaaaattcaagttatcaaatagcaatagaagtttctagcttctaaattatttctgacataaaaagtatagaacggcaaaatagttaagatttatctcagaacacactaacttgagaagatttatagaatattaaaatagaaaaatagccaacaggattaaaaggcttgtttgtacctgtcctttggaatgctctccaggtattggtattcataaatttgagtattatgatctaagtttttctgtcactatgggcatatctgtattaggcggtaccccaagcccagcaatgctgtgaggtgattctgctcttgcagaatcacagaggtgctgccttggtggtctcggagaagatcgggaaaaattttctagattgccaggcaaagactcttgttctcctctcttactttctcccaaacaaacagagtctttctctgtgctgagctgcctggagctgggagagaggtgacacaagctcacctgtggccgccaccaccactgggactgtgctgggtcagacctgaagccagcatggtactgggtctcacccaaggcccgcactaaccactgcctggctaccacgtatatttgctcaaggccctagggctctacaatcaggaggcagcaaagccagctaggctcatatcctacccttcaggatggcaagttcccctttgtcctggggaggtctagggacacaatccaggagccagggcctggagtcagatactttagaaatcaacctgatgccctattgtactgcagctgagctggtactcacaagtcaaagtccttcccactgttccctcccttttccacaagcagaagaacctctctccatggccaccactgcccaaggcccgtgatgagtactgccagggtactgctggtggtcactcaaggtccaagggctcttgagttagcttgtggtgagtgctgccaggcctgggactcactcttcagggcagcaggttcccctctggcccagggaaggtccagaaatgccagtcaagagacaaggcctggtactgggtaccccaagcctgcttggtgctctactccactgtgagcaagctagtacctatggtgcaagacaaagtccactttactttcccctctcattttcacaagcagaaatggtctctacccctagtcacccaaactggggatgtattgggtcacatgtgcatccagcatggctctgagtcacaaccaaggcccatggcaagtgctgcctggctgtgacggttgaatattcagggctcaaaggctctttactcatcaagtgatgaatcctgccaggactgggtccttcccttcaaggcagtgggttcctttctggcccaagttttctctagacatgtcatgcagtagctagatcctcaggactctatctggtgtcctagcctactgtggttgtgctggtatctaagatgcaagacaaagtcctctttactcttccttctcctctcctcaagcagagggaagaagtctctcttagggtgtgagctgtgttgcctggtactgggggaggggtggcataagcactttcttagctgtgtcagctggtgtccgactagatcgtgagcacgccaaccccactggctccgagtccagcacagcaccaggacttgccccagaattgcagtccttgtggcctagactagcatttaagtttatttagaaccccagagcactttagcccacagtggtgaggcttgccagaattagagttctgactgctgggacagacaattcccctctggctaggactagtctaagtgctgccttcatgagtgctggctaagttctgtcccacattgctttccactgtgagagggcagcactgagttcctatacaaaaagtcccacaatcactgtgttctccctccccccaggcacaccgatttcctctctgagccacagggcccctgctgggagacagggaaggggtgctgtaggcaattcaacactgtttttcagtgcctcttttagtgatatgaagttaacaccaggtactgtgaccactcacctgatttttagttcttataaaggtgatttttttttgtgcagatagtcgcttaatgtggtgatcctgcagagaggatgatagtggaggcatctatccagctatcttgctccacctcccttactatgcaattttgctaatgtctattttttaacacggtatcattgtttctctaaacatagcctttaaataaataagacaggtaaaaattttaggtgaaaatgtctagcatatgataagaatatgcaaaaggaaaataaatccagtcaatgtgccttttcttccaagttgcacctttttactgcatagtcaaatgttgtccttgaacattcttacagtataaacaaatactcaaatatgtgatttgtaataaactctattatactcttattttacgaagaaagtatttcatcatctaaaaataacatttacgtttctttcagagagtacttaatcggtcattttattaaaaatgccaatgtcagtaataattgcctataacttttctattgtgaaggtcttggttgcccaattaacaatatcaccacccccacaatatgtctatatatttaaatatctatacctatatctcataaggtttgagacagcctcatcagtatgattatcatcctgatagtgatagaactctgagacatgacaaataaacacagtattctacaatcaggttttctatcttacagatgtctgaaaaaatcaaggtatcaaatagcaatagcagtttttagtttctaaattatttctgacataaaaactatagaatagtgaaatagtaagatttatctcagaacacattaacttgagaggatttatagaatattaaaatagaaaaatagccaacaggattaaatcctgggctaagattgatgaaatattccagcaaaactttattgatctactcctgttaagtaggcagctttgaatttctgctgacaagtgctggggtaaccaatatcaaaatgacaactgaaactaaaaaacacataaaacagaacagaaaagtattcaatatctgcatgaatctcttagtaaacgaatcttctattgaccaaaaatttgatttcttttgcctctgggtataaagctgcatctggcaaattggctatgaaaataattttttggagaacgagaagaaaaaaatgaataattttagtcattctgaaatcagttaaaaattgagaccatatgaacatttattcaggttaaacttttgccttgaagaatctttattttagtttctccccaagctagattacaaggcagaaaacaaaacgtaatttgcaaacttcatgcttgacactgaggaatcactcttgatgaaaaaggcctgacttgacacatgaaaccatcagcaatgtatagaaccagagctatcccgtgtagataaaaaaaaatgctgaatttttccactagcctttcagtctcagatgactaaattatggatacattttctaaagtgtgttcatcttttaaagtcctaaataaaagtttcttactcttgtagaattatattggaaaagaagagtatacagtaacctccattaacctccaaaaccgtggtgggattctggtcagcttctagctatgtatgttcagctcctaccagatgccggatttattttatacactacctctggtctttaaagtgacctttcaggtaataacacggcccccattttacagatgaagatactaaagtacatagagtggttcagtccattcgccacgttcacacagttaataaatgaaagagccgagttttgaattcaagtctttctgaatcccaaatcctgccttttcaactctattttcaaatatgtgcccttagtggactgattgactcactcataattttgtgtcggattttaggtaggatttcatatgatctgtaccttgaaattgcaagataaggcactagaatggattccaggggttatttgtcctaaacccttctttttataatggaggtaactgaagcctagggactagccaagaacatacagcaaggtaataacaaagttggggctaggacatttatgttttaattaatatttaagctttactattaggcaaaccacaacataaaatgaaaattttaattttctgttacaaaagtgaattatgagatacattaaaaaaacgaattttcaagcattcatattatcatctgttgttgttatttatgctaatatatgattacaggctttttcatgagtgcgttctgaggttgactgcactacagaatacataacaaaaaaataagtggaaacttggtttaaaaacatacaaaataaattccacactgagctctaaaagtaggcattgagcccaatttctggaataaatcaaagagtaggcagaaaacagacagaaggaacagttattttagcaagaaaagtaggaaaaatttaccaagccaatcatgggatgatgcatgcagataaaagatgtagagagaaaatgtgcaacactgacacatgaacacatttgaatgcaagaaagcaaaaaaaccagaaagcataattgtcctaaatgtgaataaacattcaaattatgctgcagctgcaaaatttaaactcaaggaaaagacatttgcaaaggaatttattaaatagatgtgatttgctggtttcacacaaccagcggctctttcacaaactaaaatgtacaatttatcttgatataaatgacatttccccggttgtactcaatcaagtagcaaaaagtctttcgtgagagaccctgtttattaaagagcacaatacccggatattgatacccagatgcttgggctttaactatgtagtgttatttcatctaataaaaggtcttatatattgagtatgggcttatataataaggtttctgtgtgaaggaaaaccacctttctctatagcacaagccagagtagtttttttgtaagaagttaagtttcatgttgaaaccagttcttggttgctaaacctgttcatccattcttccatccatccatccatccatccatccatccatccatccatccatccatccatccatcctttatccatccaacagatatttatgggtttccaaagtctgtgacacagtaaaggatataaaaatgcatcaaaaatcttactgttgggaattttatgatattaagatggtaactgaccagaagactcagagcttgttattaaactaacacacctactcacaatggtgatgttggcaaggaagacctttcattgtgatcagtctttgactcaaactgtaacgcagaaattgtagtgccagcctggatcatttagtttacagagtggttctccaagttaaggtctcatggaacagatcagcatcatctgggaacatgttagaaatgtgcattcttgggcctcactccagaacaggggtgtccgagggagagaatacagttatgtgttcttagtttctgtttctggttgggcacggaaaaagccccatccttgtctctcttttccatttatcactagagacagaaactaaaagccatggcttcaggctgctaaaagcctaaaaggaaacaaaacaaaacagagcaacaacaacaacaaaataaagcgggctagataagcttgctctagaccaatctgtgtttgaaaaccacaaagccttaaaatcacttggaaggcttgaaaaaaatcacagcccttacatttctacacaatgggctaggccactggtaagtgaggtcaaagaataaaaatagtaagtctaacaacttagagtggcatgctttaaatgtctgcttaagaaatttagataatgatgaattggtaaatcagagaacattttctgagcaaaaagcagacatgatcagaattgtgattctggaagactttggagccaaaggagaccagggagcagtaaactaatgaggggcaattacactgttcaggtgagaagacacagtaatttttctttggttattcaggaggatgtccagcctcaaatgaactggggcccttcactcagtttgcatgtcgtggatcctcttcatccctagtttgattctgtctgctctttttggtatttctgcctagcatctgctacgactttcctggtttccctgcactaccattctctgctgccctttctcctgtcccctccactttaatttccttcacgaggaaatctgcatgcaaatgcacatcactttaaatgtttgttgttgtctgttttatttttaatagctgctccttagagagtttatcaattatattcttcctctgagcatatgatcttctaggtcacaacacaaccacaggctttatccaactttattttcaatctgtttaatgtcctcatgtcaaaacaaaacaaagaagccctgattcaccttaatgtactaaatctgttttgccagctgaccattcatctaacattatgcccagataatatatatataatttcagtcttgcatttcacacaaacagggttgtttccaaataggaaagacaaaaattaaatttttgtgtatacacggacaccttcttgtaaatgaaacaatataaagcgagtaacaaatacagctataattaaatgttgttatattaattctgactattccaacatgttggtcatactttggatctcatataatgtctcaaatatacatggggactcagatgcatttctcacttagctgacactatgccatctactgaagacggacaatttattcatgaagaagttagtgtcgaaacagaattcactcggattccatgatatttaggtataattatttaatgtctttaaaacacaaaacttttttttttcttggagatacttcatttaggagaaaaatgctgatttagaataaagtaaaaggagctgcaacagatgcggctggctccctgcattatgtcccggggttcactttggatgtcaaccacagctgcaggggagtctccttgcctttgcagggatccctaacccccaggtcatagaccagtactggttcctggtaggaactgggctgcacagcaggaagtgagcagtgggccagcgtgcattacggcctgagctctgcctcttgtgagatcagtggcggcattaaattctcataggagcatgatccctgttgtgaactgtccacgtgaggaatctaggtatgtgctccttatgagaatctcattcctgatgatttgaggtggaacagttttatcccgaaaccatctccccacctccccaccctgtccgtggaaaaattgtcttccacgaaaccggtccctggaccactgccttacagtgtacacctcaagtgacaactaagtgtctttctgctttctacccatgcatggctggcacagcccagcattgtgagggaattcatgctccttggggaaatccaaaaccaaggagaaaaagtcagtcagtaaacctcctgctgcacatctttctaacggaaatttgggcatctgtacccctcctgggaggaaccaagttcccattgcctgcagtggtagacttgctaacccacccataatttggcctgcgcttcttccctgattcactcttcctgcttccaactcttgatctttggatcagctccctaataaattgccatacccaagtcactgtctcaagcaagtaacgcagacaaagacaatagcttattattcagcaatatgaatctccttctgatctgacaccacttctgtagtatatttgatttatatgtggtaagacccttctttttttctccctccaaaaactacataatgaaaggagtggagatgatagcaaggactcaagggttttcattgcctttcttttgttttcttttctttttttttgagatggagtctctctctgtcaccctggctggagtgcagtggtgcaatctcggctcactgcaacctgtgccttccaggttcaagcgattctcctgccttagtctccccagtagctgggattacaggcacctgccactgcctcagtctccccagtagctgggattacaggcacctgccaccacacccagctaatttttgtatttttagtggagatggggtttcaccatattggccaggctggtctcaaactcctgacctcaggtgatctgcccacctcggtctcccaaagtgctggaattacaggcgtgagccaccacgccctgcctttcattgcctttcttagcacacttacatcatgttgaacatgtctgtgtggataaatgcaaatttgttcaatatgctaagaaaagctaacactatgccatttacttccataatttcatacctaacctaccttatgtacaatatttgggtccacagatttataaaaatggcatgtgcccaatatgccgttccagattaacaacaacaatgaagattaaatatataaaatacatctggcctagattctgtacaggtagctaggaagttaaaaaacacaggctttaaattcaacagactgttaatatgtctggaaagtgtatgccaggaatatttttgttcaaatataccatgctattaaaaaatgtttcatataggatagctgaagaggaagctgttatttaagaaactgcttcctatacaagtaagggggaaagggggcagttttacctttgattatcaattgtccattttccttgcttccgagtcaggaaaagatccaaattgcaggcttttttttaacctgatgtcactctgggtatctgatgttcaactgctctgaaacataacaatgcaataattagatgtaataactagcctgaaacaaaaagacacttaaaaatgatctcataagaactattctgacacacattatattcaatgctgttaagaagagagtttcatagaaaatctacatggccgtgttcttgcatgatgtcacactttgtatttttatgcttttcagaaaataaaatcaatcacccagaaaaaaaacaatgttgctgtaataaataggcttgatattctacaatatacatttcctatcatttattttctttaaaaagcaataaaatgcaagcatcaatgatccaattctgtaagacataatatacatatgcgattgtattcacttcctgagcgttatttgttttctcaacagtacaactaagccagtgtgactttaaaaagggctaaaatgtatcatttttttccagagtggttcttttcattctggaaaaaagccacaggaggatgccattcatggcataatattcccaagtgtgctactagagacttgctggtgcctaagtcaagccactatccttaattaggacaaatacctaatgcatgcgggtcttaaaacctagatgatgggttgatgggtgcagcaaaccaccatggcacatgtatacctatgtaacaaacctgcaagttctgtacatgtatcccagaacttaaagtaaaataataataatattaaaaaaatagtttcttaggaaagtgacaaaatggaacatataactggacccacacttatgaaggaggtaactattccagatcatatcacatgctatatggctgagctatgagtttcctttctgaaaagtgacatagaaaaggacctgggtcacacagaaaactgatctgatgtcgaaaagtgtaaatacctgtaaaggtctgtttctatttttttgtaagcaatgtattcttttggatctaggtagcatattaaaatattgtcagaagggaatgagaaaaataataaatctaagtaataagcagaaatgtagtgatattcagaattgagaatataatttgtatttttttaacctcctaattataagaattatagtgcttaaatgagtgtggaattcattttacagaagaggaagtagatgtcagaggaggtgatatggctcgatcaattttatgcagtgaataggcacagaggcagaggcagaattacgtcccagatgctctgtctggaagttcagtctctttagaaactcacatcttgtttccaaaaagaacactggactttcaaaaagttcagggctagtacaattctctgcagaatttgttagagcaatattttgagactggcaaagctgacaggtatgaaagtgttgtgggtggtaaaaggcaagaacaacagaaacacaacagcctcaggcatgataataatacacaggaggaacacttgactttcacacatacctctttatccatgacatagaagacaaaaatgagacgccatcatcaaaagcttttagtcatactttaaagattatgagccctgatttatatactagtatcctgctaagtattttcaatattccattaaaccagacaagctctgagtggactttcttccccacatatatgaggactaagtaactcaggagataatgaaaaattgttaatttctaaaaatatatagaactgatcatttatccgttcatgactatttattgagaatttattgtctgctagatagtactcttaattttctttggaaacaaagtggaaagattatgtaatttctgaaaaagacacccaaaacacaagaagaaattcattttattataattggttttataagttagataattgttaggtaaacaaatatattaatcactaggagaggtcttaaatgtcatctagtgtaatggttgccaaatgcagttgatcatcagagtcatctggaaatttgcattaaaatacaattatagaatttcatgcaagatcgtttaaatcagaatattcatgggtaaggcaggggaatctgcattttgaaaatgatcccagctaattctcctgatgaagcaggttgggaaacctaccaattctgtctgatttactcattatatagagaagggcattgaaaccagagaattgacttgcccagggcatttgcttcttggtgacagcactgagattaaaatgcagaactcctgattctccattttcttttcttttccttaccccaagtgtccctctttttaacttttttcttcctgttcttttttttaaccaccacataatcaagatttagcatctatatctgagaaagaacaagagtaaaagaacaagtacactataattatttgagtatcagaagattcaggtacgttttctcattagcaacaatttacacagatgaaaggtgaaaaacaggaatttggacttcagctgtttgattcaatcatgtgcttcctactcttccactgtctttttctagaatcagctacttgggagttgcctgctgagtccctttctttggggtctgcccagcactctccatcctgcagttgtcaaaggggtcctcgttcctggacatccctgattggaccaggagaggtgtttttcccaaaccaggcccataactgggactgtgagactatagctttgtccaggttaaagagtgatgggtaaaccatggagaaggaagaatggaagagacacacatggaaggtggaacaagaactctctcaactcatctgcctcctgctccctctttttcattcttttctgtggctttcatgggctcatgtatccgtaagagataaagagacggaatcttgctctgtcatccaggctggagtgcagtggtgcgatcatagctcactgcagcctcaaactcctgggctcaagtgttcctcctgcctcagcctccagagtagctgggactagatgtgcaccaccacacccggctatttttttttttttttttaatttctcgtagagatagagtctctccatgttgctcaggctggtctcaaactctggcctcaagtgatcctcctgccttggcctccgcctttttttttaaataaaaaaaattaaattactaatttttaaattaatttttttggcttaagctaactcaagttagtttgtttctgtaactctgcagccagagtcaagatgaatacacctcatatcattcattttatgtgtgttactctataagccagtcactttagttacggtattccaagaggcttatttaaaaactattggctgagagtgcggagaaggaagaatacacactacaaaggtattgcattttatggaacacctatattttcatcaaatacatgttttgaagtgtgataaagtggagaaggtcccgatcaggaagtcctcttttcatctcagatctgactcttacaaagtttctgacttgtgaaagttacctagcctctctcagttttaatgtccttatttgtaaaatacctcctggctaactttagccaggttagtatgaggaacaagggaaagcactcattcattctctcattcattcattcgccccaccgttctgcaaagatttagcgagcatctatcatatgccaagcactatctaggggatgagaatacattagtgaacatttcattttagtgaagacaaataaacagaaagtaaataataaatgtaaaacagtaaattatagagcagttcagaaggtgaaacatgctatagatgtgagaaaaacagaccaaggtaagaggtatcagaagtgcataggtagggaggtgtagggaggagaagggattccaccaagaaagtgagatttgatcaaaaacttgagagatgtgagggagtgagtcccatgccagagaagggtgttccaggcagagggactgcagggttatagtgctaaggtgggagtgttcctggttggtcttgggattgcaataaagtcatgggatggagtgaagtgagggaggagattagtaagtatgtgcacaatttacttctacaaatctgctgcccattgtgaaccatgtgggaactgatgaaaataagtcgcaacaatttgctttatttgggcactctacggttcacaccatgcttatatgtggatttgcccaccctgctacttggaacacattttcctccctgggtcttttaaggcactgtgaggaatagtagtaggtacagataatacaaggtagttcaactaggattgctaacctcatagacttttctcccacagttgctgtttagtatattttctgaatgtaaagatgtgtatatttttccttccaaagtagtgaataaggaattcattaagagcaaactacactactgaaaagtgggtatatgtatattaaaagatatatgtccagcaattcagtacttagacaagcttatgagcaaagatgagctgttatgaatttgtaacattaaacatggtgggctggtggggtgctgtggggaagtggaagaaggagtggatcaaggatggctcatggcttttcagcttttactctgagagtgaaaagggggccatggcaggagtttgagcttacagtcgacatggcttatgtttcaaaacctcatcctggctgctggtttggaacagtacataggagaggtcaggatgcaggtagctggaaagcttgtgaaccacctggagacaggcaacatttgctccgactcgggtggggctgaggagcagtcagatccatgctgaacttgttctgaagcaagagttgacaggaccttttgatggattgggtgattagggtgagaaaataaagagacaacaatgaccccaagatttctggcctaagcaactggaagagtgacctcgacgtcgctggagatgagaaaggctgagtctagagcaggctttttagggaaagctgatacgttcagtctggccatattgattgaattatcagtgccaactggacttgccacataggtggctggatatacaacaccggaatgtgggagagaagtctgggctggagtttgtgttagaagctttctggtatagcataggtgattggtagtattcctatttccaccaccacagatgattatataaggattaaataaaataatatatgtaatgcacagtacctggtatgtaacaggaatgcaacatattttaattcccttctgtttcctgccgttatttaaaaatgtatctttttctactgactatattataagattatgttatctttctgtgaaaaaccaatcaatttctgcaagacaccatatcatactttacattttggcagtcctttttaaaacaaagggaaataatctcctgataaaatgttgataatcatactcagtaagtcataaaagagaatttccaggaagcaaggtaaatttttgtttggataggagatgaaaggtctaaagagaaagtgaaaactgaacagatatgaatctatagacctaaaaaaaccctaaacttatctcagatctccctggattattttggacacagatcttgctttttttactttatcttctagcacttaagaatttttttttgagcaatgattaatagtcctataagatgaagaagatgcagaaatatgagaaagatgatcatggccatagggccgagtgcacagctgaggaggaacatttctgaaaggcatggatggctgagaaactctggaagctctagggtgaaatctttaaagtctacagttgtatctttaaaatgagtttcttgatttataaatgcctctttcacagaacaaattttaaactagaaaccatctatgtttaaatcctgttttagacgtgaagtttatgaaaactagacggggacatgtcttgtctgagatcatggaccaccaagatcagaggtgggaccgggccgtcagctcacttaactctgggtgcttgtctttgcactcaaatagtttccttaagttgttttacccaactccctgttttatgtaacaagcatcatttgttttaaatctcacattttatcttaaattttaccttatagtccataaactattatgtaggtttgaaaacaatggtaaactatctatgtgcttcactccagtggatcgtagaaataaattccagaatgaggtctgcatttattctgtgactttccacgtgtctgagacagcattagttcacataataaaagaaggaagactagtcagtttccactttctttgcaaatcactttgctaattggttcctcatttgtgtataagagatttcaaggcaggctggattcatgggtgtgtgactcatgcagcttcagagggaagaccccatgctcagaaaagccctgtgctttgttcagtgattttagtagttgaaccagtgttttgtgggcaaagtccaataggacagtgagcatcaagggagcaggggctgtctgcacactgtgcacatgctcagccattctgcgctgcctcattcatacgtgatgttcataatggtgaattctgggggatgcacaattcatgggagtctggtgagtttcaacatgagagcacgagtaagtgtgctatgtctgtgagtaagtggggaagctggcagccccaagacgccatgctcgccactggaaccagaacttccttcaaccttagcaagaaggcaaagggttttaagaaacacagatgaccacgggagcctattgcatcctttcttccttgaataattccctgtatcagccaactgtttatgctgaaaatgaagacatacaaagagagagaaagaaagagcaaaccacaggtctttttcttgcaatccttccttactcatgagtaagtcaaagggagagagtgtatccagaaatgaaatataaagttatttaaatcttgtatatcatttccactgtttgggtaaggatgacatacatatgtacgatctatgaaatacctaatttttgctgattgtgcatgcaaagcaactattcttatagttgcattgcacaatacaaagtgaatggtaaaatttgtgctaagtttatatttttgttttttatttacttggaataacatgaaatatcaaataaaaactagtagaaaaagtcaagaggggaatggcagaaggaaggacagttttatacattatcacctttaatggccctttgttcctgctttccgaataagggacctgcattttcactttgccctgggccctgcaaattatgtagccattaacattcaccctgatgttatgaactggcacacaactagcattattaacttacagcttaagtatcatatagagaactttggaaatagaacaccttcttttgaaaatcctagtacaactgcaaactgaattaatctgctctctgttctcctcaacgtcttctctcattttccgactgacttcttggacacttgaccaaagttcctaattcaaattaatccttctcagaagtcccccagctcttaatttaatttgatttctaatttaattcaattttaatattccatttgaaatgccactgccctcaaggtcaaatactcagctggggaagagagaaaagtcagtgataaaagaaatttagtctaaggtgtgaatgatgaaaataattgatactttagagggatattaaggtaagcatatgtccaaactcatcagattgcatatattgagtatgtacagctttttgcaatcagtcatacctcaataaagctgttttaaaaaaagaaccacttgttaggcctaaatgaccttaattagtaagaaacaatattttaaaggaagaaaacttcatattactttctgctaagaaggcccttctaccctaatccatttgaaagaatgagcagttgcctatttctgaacaattgcacattatttctttaaagatgacataatgtgcacatagtaccttgctgcccagctggtttcctgtcttcaactctcctctcccatccattctccaagtagctgccagagagtccttctaaaatactatacagtgtgaaactgatcggcttaaactcaattgcttgcagggtctgatacaatctccttggttaggaagtcagtgcccttcatgatctggccctgaaactctgctttccttctccaatactgtaaactccaacagaaccaaactgctttcttgaactcaacctccggcttttgaatcattgtccatggaccaagcctttgaatctttgctggtctcttctttgcccggcaaactcctactcatccttcatgaccccaccaaaaattaagcttcttctctgtagccctttcttcactcttttcctatttatctgtttttctcagtaaaatgaaagctccccacggaatgaacctgtgttgttcatctgatatctttggcacctaaactcaagtttggtacattgtaggtactatacaaatgtgggttgaatgtaaaaaaaaatgaagtaatgtgtactcaaacataaccaggtattttccagttaattgaaaagggccttacaatcacgaaatacataggcttatttcatttctttaaagttcaccaaaaagaaaagcactttaaaataggtagtgctagttggaaacttagtctccattctcttgtttgtacttttttttggtctgcgttcttctctcttatccttatatctcagtccgcctgtggaagcttggcagcttcaggaatttggctaaaggactctgctgaaatgttaaggtactgcctcccacaccaactcacttcttcgcaaataagatgattttgggatcctccatgaacagaaagtgcgtaatgactcattgtgatatcacaactgttgtcttgttacaaaaagatttacaatttatttacaactaagatattgcactatttggtaatatcttataatctgtgtgcagaagaataaaaatccttttccctaaggtagaattcttggctaaaaggaggtttatcaaacaagcattgggataaactggagattttgatatttgttgtcaatcacttatgtgggaactctccatgtcttacatttgcaaggcatttttttcttaaaatctctgagagtaaaattcactagactattataatctgtttgtccctactgaactcccattactttctctccatccactgggctgactgcctttcacatctctttcagtttttccccctctgtataagcttaacttctgttataagaaaagctacaatttattgagtacattctatatgccagactcttttgtaaagcatattattaatgcatcgattatttcatttaaaattcacaataagcctaatgaggtaggttcaatgattattaccattttgttcaatgattattatccctcagaagactgagatgcagagatattaagaaactcatcttaacattagagatgttaagaaatcaaaatattacacctgtaagtggatgtatcactatacagacctaggcagtctggtctcaatttcacctctcagtgtttgcctcaagtcaaatgtgcagatttattttttatgaattaatttcccccttcttatttaattccttaatataagcctgtctgtaaggctttcaaagtttcccatgttccgggaactttaaatacattacttcatttagatattattatcattatcccattctacagataccaaaattgaggcactaagagattacgttacttagccaatgagatctcacagaaaattctggaaccaagatttaaatctagttctttttgtcattatgctacattgtactcttctgtgtcagattttgttttccttatgcttttttttttttttaatggctgaacaatacattccacagtttatttttttcttcaacttttaagttccggggtacatgtgcaggatgtgcaggtttgttacatagataaacatgtgccatggtgctttgctgcacagatcaacccactacctaggtagtaagcccagtatccattagctattcttcctgatgctctccctcccgccacctttccccaggacagacaccagtgtgtgttgtttccccgaccaaccccacgtgtccatgtgttctcattgttcaactcccacttatgaatgaaaacatgtggtgtttggttttatgttcctgcattagtttgctgaggataatgccttccagctctatccatgtccctgtaaaggacatgatctcatttcttttcatggctgcatagtattccatggtatatatgtaccacattttctttatccagtctaccattgatgagtatttgggttgattccatgtctttgctattgtgaatagtgctgcaatgaacataagttttccctgttcttataaataaattttctatgccaaagtatagaagagccttattttttaaaaaatcaggttggtgactagttcatttgttagagccaaatttttagctgccaaagagaccaaaatcttacttccgagcctgtgtatgccagttggcaatgctggttccactgccacaaaatgtaactctgttcccagacagccacttggaaaatgcatgctgctaatcatgaagcagagaattacgtacctttaaaggttgatggaagtttatcatgcctcagatctaatataatcatttcatatataagaaaagcacagagagattaagtggcacacctaagatgacacagtaaattcatagcaagcttgggacagtcattgagattttctgacactaaatctgaggtcttcatcccatacaacaaaagcagtctctgcagccattttgtcattgtgtcttaaaaaaatgtattcatacattcaacaaatactgagtggttacctgtgccagacaatgttctagatgctggagatagagtagtaaacaaaaaagaaagattcctgcacccctggagctttacatcctggcattgtaatggcagaatggaacaaactgttatggaaataaggatgatccaaagcgataatgtctcataggcagaagagcttattagtagagttacagttttgtgcatatactcaaaagcctactagttacattgaaaggattattggtatcaataaataggaatggtgtgggttatgtggtaccaatggagagatgataagatagggtctctctgctctcaaggagcttaaggatgaagtatgtcatgtagattaaaggaaatgttttactttccaattaaaatttttaaagaaaattttgtcacattaaaaattatcttttaccttaacagataaaaatcattgtgtgcacctactaatccaagtcaattataactacaaggaagtaaataatctgaaatccaaaaattccacctaaattttctgagattaatccatttgaagtctttgaaaaggttctatacctgattttatatgaccatgtccagtgtcagagaaataactacaataaagtattaaatttgcctctaagtcaacatatatcttcttcttgccaataattattgtaataaagtggcaaaattgagctcctggtcacaaggtgtggtgacatgtgctattagtctgaatagaaacagccaccctaaagctattcaataatggaaaacagaaagctgtgcaatttaaagtgctctactaagcctgttccttaattacaatattttgcaatgtcaacgcacaccattatctgaaataatcagagtttttttttaaaaaaaaacataatatcattctgttttgagctagtcgcaaagtactctttgttgtcttccatgatgttaaatgcttgagtctgactcgcccactgctaagagtgttgagtaggtatagctgatattctgtccccattgtaggccagcactaagacatctttactaatgtccagcaatagaaagacatctaaacccaagatatagtttaatgttacaaattcataaccactcatctttgctcataagcttgtctatgggctgaattgctggacatatatcttctaatatacatatacccactcttcagtagtgtacttttgtctttaatgaattccttattcactactttggaagggcaattatacacaactttacattcagaaaatatactaaatggtaactgtgggagaaaagtctatgagcttagcaatcgtagttgaacaacgttgtatatctgtacgcactactattctttacagtgccttagacggcccagtgaggaaaaggtgttccaggtagcagagtgagctaatccacacgaaagtgtgatatgaactgtagagtgcccaaataatgcagtttattgtaacttattttcattagttcccacatggttcacaatgggcacagatctgtagaagtaaattgtgcacatacttcccactgccaatgtcatcacaataaaatgtctgctaaaatagagggcagtaattctgttgatataataattagctaagacagtccattcccgaagcaaaaacagtgaacagaaatgctgggagcctctttttatttcctttgcttccatcatggattgaaagtttgtagggccatctctggaaaatgccgtgagagagttacattttcttccatacttttctgtgtcccttttctgcacctctcttttccattttgatgttttctttttcagatattattattcaaatttcccttcattaaaattataattctccacaagaagtggtccagcccaagaagtctccttgtccctgtagatctaagatgctcctccctcactgagagacatccaggggcttggccagtgaaaattcactcagctcactcatgtagtactagcacgggtgagtggaaactctggcagcaccagatgaatccagcagaccaaaatagcaatggaaagcactgaaaactaaactgccattggaaccatggtccatagaagtaggccagaacctgcacgctaaacataacagtgtgagtcctcactaaaatcaaagatttaaacaagacccagagtccctaatttaacggataaaaggcccaagataccattaaaaaaagaaaaatcacctgtcatacaaaaatcaaggaaacaacaacttgaatgagaaaggacaatcaactgacaccaatattgagatgaaccagatggttaaattatctgatgggtttaaaacagctatcataagactgtttaaacgatcagacactgccggggctgggtgtggtggctcacgcctgtaatcccagcactttgggaggcgaagatgggtgatcacctgaggtcaggagtttgagaccagcctggccaacatggtgaaaccccgtccctactaaaaatacaaaaattagctggctgtggtcatgggcgcctgtaatcccagctacttgggaggctgaggcaggagaattgcttgaacctgggaggcgaaggttgcagtgagccaagatcgcaccactgctccccagcctgggcagcagagaaagactctgtctcaaaaaaacaaaacaaaacaaaacaaagcaacaacaacaacaaccaaaaaacaaatgcaagtgctcttggaacaaatgaaaaaatagagaatttcagcaaagaaacagaaattataaaaaaggaccaaatggaaagtctagaactaaaaaatagaaaaacataattatttttaaaaaaagaaccttggtagatggactcaaaagcagagtgaagataacagaacacagaatcgatgaacctaaggatagatgaattgaattcacacaatctcatcaacagagggaaaatacaatattaacaaaatgaacagagtcttcaggggcctttaggaagattacaaaaatccaaattcatatccttaaaaagaatggagagagggtggggctgaaagaatattcaaggaaataatgattgaacacttcccaaatttggtgaaatacacatattcacagagtcaagaaaactccaaacaagataaaccccaaaaagtgtagactaattaaaattaaactgaaaagaaaggcagagaaaatattttgaaaggagtcagagaaaaataatgcctgtctctagggaggcagcaatttgaataacagcagattttgcatatgaaaccatgaaggccagaagaaagtggcaaaacggttttcaagtgataaaacaaaaatgttgtcaacagcaaattctacattcagcaaaactgtcttcaggaaagaagagaaaataaaggcattcttatgtaaaggaaaattagaaaagtctgtcactacccaacctaactttaaaacttggctaaaggaagttcttcaaacagaaagaaaataataaaagaatctagaagcaaaagaaaaacaggaacaagtaaaagagcagaaatatgggtatattgtgagtttcataaaatatatttgatgactgaaaaaaatattaaaatgcaatctgatacttaagacaatcatatctaaaagtggggaaggtaaagacacctgaatggaagtggggctcccacactttacttaaaaaggtaaaatgctggtaccagtagactgtgaaaagtcacatatgtatattgaaatatccagagcaaccactacaaaaaccatacaaggagatccactcaaaaccattatagagaaaatatttgcaaacatatgtctggtaagggactaatatccaaaatacagagagaacatcaagctaggtacagtgactcatgcttgtaatcttaacactttgggaggctaaggtgagaggatggcttgaggacagaagttcaagaccagccctgaacaatgtagtgagaccctgtctatataaaaaatcaaaaaaattagccaggcatggtggcatgtgcctgcagtactagccactcaggagcctgaggtagaaagatcacttgagttcaggaatttgaggttgcagtgagctatgatcatgccactgcacttcagtctgggtaacagagtgagatcctgtatctaaaacaaacaaataaacaataaccacaaaatccaattaaataatgaacaaaggacttgaatagacactactccaaagaatatatacaaatgaccaatagcacatgaaaagatgctcaatatcactaaacactagggaaatgaaaatcaaaaccacaatgagttactacttcatacccattaggttggctgttataaaatatatatatataagattatgagtgttgacaaggatgtgaagaaattggaacctttgtgcattgctggtgggaatgtaaaatagtgcagctgctatggaggctgaggcaggagaattgcttgaacatgggagacgaaggtcgttcctcaacaaattaaacagaattatcacatgatctggcaattcctcttctgggtatatacccaagaatcgaaagcataggcttaaacagatatttgtatactactgttcacagcagcattaattcaccgtagccaaaaggtagaaacaccatccacgtgttcatgaacagataaatgaatgaacaatgtggtatattcgtatgaagaaatattatccagccttatgaaattctgacacatgctgcaacattgatgaactaagtgaaataaaccaaacacacaaaaagataaatattgtatgtttccatttacacaaggttcctaaaataggcaaattcagagagacaaaaagtagaatagtcattagcatgggcttggagaaggaggaaatgttcttgcttgttggatacagagtttcagtttggaatgatgaaaaatatctgaagatagataatgtttgcataataatgtgaatgtacttcataccagtgaattgtacacttaatgatggttaaaatgataaaccttacattatgtatattttaccataataaatagacactacaaattaatcaagacagactccaaaaaatgttcaaataacaggaaagcaagtaaagagaaagagaaaaaagaaccagaggaaataaacaaaacaagtaattaaatggccaacttatatgccgacatttcaataattatcttaaatataaattatctaaatacaccaattaaaagataattattgatagagtaaataaaaacatggccctactatatgctgtttggaggagatttatttcaaattcaatagaaaaaatatatcatgcaaacactaattaaaaaataggtgtggctatgttaatgtcagataaagtagacatcagaacaagagaaattactagagaaagagagggacatatcacaatataggattagctagaaagatataacccctgaatcttaaatatgtatgtaccaaatgaaacttgaaagaaatttcacctaagagggtacatgccactatcctatatgtgaagcagaaactgataaaactgcaaggtgaagtagctctataatcatagttggggacttcaacaaccttctcttagaaaccagtaaaactgctagccaggatattagcaagtatatagaagagctgaacaacacagtgaaataacagattctaactgacatatgcagaactatatccaacaatagcagagtacataagtgatttcagcgatgttgctggatacaagaccaatagacaaagatcaatcatatttctacatactaacagtgaacatgtggaaacaaattgaaagcacagtataatttcaaatgctgcaaagaaaatgaagtacctaggtacacaaaaatatatgtacagaatctgtatgttgaacattataaaattctgatgaagaaataaaagaagattgaaataaatggaaagacatattgcattcatggattggaagactcaacatactaaagatatcacttctacccaaactgatctataggcttaatgcaattcctatcaaaatcttgtcaaggtcctatgtagacatggagaagcttttaaaaaaatgtatatggaaataaacaggcgctggaatagctaaaataatcttgacaatgaagtatagaaatggagaactcaatctacttatattcaggcttgataagtagctgtagtaatcaagacagtacggtattggtggagaaacagacattcaattctatgaaacagaacaggaaacccagaaataggtcctcaaaaatatgttcaactggtttttgacaatggcacaaaagcaattcaatggaacaagggaatttttcagcaaatattgctgaagcaattaaccatctataagcaaaaaagatgaacctcaaactaaacatcatgcctcatacaaaatttaactcacaattacattctaagtacattaaaaatgttgtacagtcaccaccactatctatattcacagctttttcaccttcccaaactaaaactttatacccattaaaccataactccacattccccccttctccctagtccttggtaaccactattctacttttcgtttctattaatttgtctactctagggacctcataaaagtggaaacacaatatttgtcctcctctgactagtttatttcactcagaacaatgtcttcaaggttcatccatatttaaacatgtatcagaatttcattccttttaagtaaatgattaatttatttattttaaagatgggggtcttactatgttggccaggctgaactcgaacctctgggctccagtgatcctaccacctcagccttccaagtagctggaactactggtgtacaccactatgtctggctctcatttcttttaaaggcaggataatattcctttgtatggatatattttgtttatccattcatcctcttatagacacatgggttgtttccaccttttggctattgtgaattaatattgctatgagcattagtatacaaatatctctttgagtctctgcttttagttcttttgagtatgtttctagagtgcaattgctggatcatgcagtaattctatgtgtaattttttttgaggaaaaaccatattgttttccaatgaggctacactatttaaattaccacttgcaatgcacaagactttgaattttccaaatccttgttagtatttgttatattctgttttatatgtataaactaatgggtgtgaagtggtatctcactataccacttatggccaaactaatggatgtgaagtggtacctcactgtaattttcttaatgtatatttccctaatgaggataataatttttgaaaaagttaagtgtgaaaagaacacaacttgtactaccctttatgatcagaaaagtaaattattttgaatcttatgtaataaatgtccatgtattagttatactattcaagggagataacctaacaaaatacatatggcaaattaaaagtatctgttggttaagttgctatcattaacacatactttttgttagaaatctgcttaaaaacatcccagctccctcaatgctccgatctcaaccatcataggaaagtttcatgtttcccagtagaatcaactagagctcagcttgctgaagtcccaggagtattttcatttcaaagtgttattagtcaaaataaatacatctttaacgttctacttgtataaattatgccacacgtgcatgggcagagcaccgagtctagttccaatctgtgtttctcttcttcatagttgtgccattgtaaagtagtgacttaaccctttataagactcagttgtctcaggtaaagaaagcatgagcttaggaatcagagcctgagtcaaatccttgctccatcattcatagctaaacttccagagtctcagggcccttattgtaaaatgtgaaaataatccactcactctacattacactcagctctgtcagaattaaatgaggcaatgcagtgagggatgggcggggacagactgttagggactatttaagagacacatgatgatggaaggttgtttccacgatgatggaaggttgtttccaccttccatcatcaagtgatgatggtttagaggaagccagtagcagagcagataggtaggaagagtaagattctaaatatgttttcaatgccaagtcaacaggatttgcttttttattgaacgttgggcatgaaagaggagtagaggaagaattcaagatttttagctttagaatgggattaatggagttccatttactttgatgaagactgaggttgaaaactttccagtggtaggtaagctcaagtgttaggtcggacatgttaagttttaaaatgtctattagacatcctaataaggatgataagtagggaggcctgatttatattatggaaaaatccctgaagacaggtgagaatggggagtgaggtcaggtgaaagccactgatataatttaagcaagaatacagtagggcctgaaaaaaataagagatttaacggagtttagcagaaactgaggataaactggatatgagatataagagatagggaagactcatgaatgaccccaggacatctgacttgggacactacataagagttaccacggtgtgggagaagcagcaaatctgagtggggaaaaaggagtgaagctatctattaatagcttaatctaatctaatctaatctttatataataataaccttacttatttaaataagaataaaattacttattgtcttccacaacaaaggataattccagttatttttcataactgaaaaagagtattagtgttcatttagattttacctttatttgtttgtttgcttttgatgggggttatatacaactgggagaggaggaccagcttgagaaccacatatgcatgtgtctgttcttgcacctcagtgaactctgttttttaacatatcagaattttaaggcttaaatttgcatgagtatatgcgctcatatatgtgtgtaaatatcataaataggatattattcatatttttaaatcctccagtaatcattttctatatagaatgaaaaaacttttaaccaacaatacaacgtctgcatttatttgtccatatatatcactagtctgaaaagtacgatataaataatttcttaaaatcaatgttaaatggtggtttctgcaagccaaatgcataaggcctctttaattgttaaagatagaaagtattttgccaggcgcggtggctcacacctgtaatcccagcactttgggaggccacggcaggcagatcacgaggtcaggagattgagaccatcttgactaacatggtgaaaccccgtctctactaaaaatacaaaaaattagcccatctctactaaaaatacaaaaaatcagccaggcgaggtggcaggcgcctgtagtcccagctactcgggaggctgaggcaggagaatggcgtgaactcggaaggcgaagcttgcagtgagccgagatcgcaccactgcactccagcctggaagacagagcgagactccatctcaaaaaaaaaaaaagaaaaaaaagaaagtatctttaggaggcgaattattgagatgaaaagcccactcagcagttgagaatacatgatttcaggaaatgattcaaagttattttctaaaataaattttattatagaaatgtcaaattcactcataaacctagctttcagtgttctctaatatcgaagagcacaaatgtcatagaaaaaataattacaaaatatggttattatgtacttctaagtagtaaaatcttgattccccagtattaagccaacttacatccttttcacaagttcacttctgagtgtatattggaaaaaaattacaaactgcgtcttgtcctgtttaaatagactagtgactaagcaaccagggcacagagcctcctggatcttttttttccaaagatttttccttctagcacttgagataaagaagatcagatggaagacaatcattatgataatgagttttttccttccttttcaaagagtttcagatttgggttttgtaattctctgaaatactcaataacatcatcatatttcagaggcaaagacagctgattagaaagttgatccaatggtagagaacctttgcctcagatacatatgtcttaatgttcctgtaaaagtacagcagaaaactgcatttttggagaatgaaccataaatagaagttattgtgttaattttgacagctgtcactgaagttgacaggatgtggccacctccaatttgaaataatttttctgttcaagataactacataaatgccaatgttcgtcccttttaatttctctgagtctcatgacttaagagtcacatgtcttgtacacaggcaactttctaaatatatcaccatttagtcttgcatgcgcgtgaatacatgcatgattcctatacataccacttgaattctgagtaagttttctcttctaaggagagaaatggtgggattcctttatatctaattccagttatttcaaagctgatcaacattattgagcctacccatcaaattaaaataaaatagaatgattcaacatagaaaaatgtcaactggtgaacataagggtgctgaaataaccaatcacagtttggcaaacacccaagccatcccccatagcaacagagctgatggcatagcaaccgcagctgcttcaacccagaaaaattagaagaaatattcttgggaaaaaagcataatccatgttaaagtcagacatgacattttttctgcaacaaaagaaactgtaagcatgaatgtattaaacgatacaattccttagcagctgtaaatgctctagtgcaggctgaaagccactttgattacaatactcaaggccaagtgctttgaagctaaaacttcctaggttgttctcatccaaactgttacgtttcttgcaatgttagagaacaatcttttcttcaaccatttattttgctatgatagaaggttttccacaattttttaaaaggatcatttgagagaaagatttactggttagaaatccacataatcagtacttgagaaatattaaaatctaaaaggaaatatattgattaaagtggtgatgatgtcatcctgagggatccaggaagcatgaggatgaaacattagctgaagaaccaagagcctaataatatttggatgtaccctcatagtagtttgacctgcagggaattcaaggttttctgcagagccccaatctcaggctttagctagatatatagactttctttactattccatgctggtttctctagaagcccatacaattacaatcagtcaaggtagacttctgaacttgttgctgaaggctgaaaggtggggtcaaattctttatgatcggtagagacgatgtaaccatacaatgcctctctcctcagggatattagacatttgctttattaagtgtagaaagtgggatgatgttcaactgatttcagacattggttattttaatcaactcatttctcatggtttctatttgaaaattaaaaaaaaaatcctaggctctacttattaaaattcaaggttttggacttcacatgggaagcatgacactgcagcctagcccagtcgtagactgcaaagtctcagtaaaaaggaggaagagaaatgcacatatgaatccagccagactctgagccagggaaaccttccgtgatttggtgaaaaataagacagtgaagtaaacagacctgatggaagctcaatatatgtaatggctgctgagagcttgtcccctgacaaaggggcaatttcaaatatatggtccttttcctcctttgacccattattgcacccggttggatccactcatggtttctacctggctctcgggacatctccagttcctttatcctcagaggaatgacctgtatcactatttacataagttccaccttctgcacccctacctggcctccctttccctcacctcccacgctaaaaattaaacatcagtgattctccttgacctaggattcactcaacctccaccctctttctccagttttctggaatgctaattggacattttattcagtgcttcagggcattagtcctaggtgcctgggaatattccccaaacacagcactcccaattacctgaattctaaccacaccgaatcccaacccagaggcccaagaaggagcttcccatctgtggtagaattccagtccttaagtcaggggataacacctgccctgagctgcctgtggacatactgattaacttcattgtttttattttattttattttttattattattttttcgagacggagtcttgctctgtcacccaggctggaatgcagtggcacgatctcggctcactgcaacctccgccccccgggttcaagcaattctcctgcctcagtctcccaagtagctgggattacaggcgcccaccaccacgcccggctaatttttgtatttttagtagagttggggtttcaccatcttggtcaggctgatcttgaactcctgatctcatgatccaccctcctcggcctcccaaagtgctgggattacaggcatgagccaccgcacccaaccttattttactttattttattttactttaagttctgggatacaagtgcagaacatgctggtttgttacataggtatacacgtgccatgatggtttgctgcatctattgacctgtcatctaagtttcctcacctgccaccccccaactggccctggtgtgtgtgttgttgccctccctgtgtccatgtgttctcattgttcaactctcacttatgagtaagaacatgcagtgtttggttttctgttttgtgttggtttgctgaggatgatggcttccagcttcatccatgtccctgtgaaggacatgatctcatttttttatggctctgtagttttccacagtgtatatgtaccaccttttctttatccagtctatcacaatggttgaactaatttactttctcaccaacagtgtaaaagcattcctattcctccacagcctcaccagcatctattatttcttgactttttaatagctgccattctgactggtgtgagatggtatctcattgaggttttgatttgcatttctctaatgaccagtgatgatgagctttttttcatacatttcttgcacacaatgtcttcttttgagaagtgtctgttcatatcctttgccccctttttgatggggttgttttttttcttggaaatttgtttagattccctgtaaattctggatattcgacctttgtcagatgggtagattgcaaaaattttctcccattctgtaggttgtctgttgactctgatgataatttcttttgctgtgcagaagctcttcagtttaattagatcccatttgtcaattttgacatttgttgcaattcctttcggcatttatgtcatgaaatctttgcccatgcctatgtcctgaatggtattgcctaggtttttttctagggtttttatggtttttgctattacatttaagtctttaatccatcttgagttaatttttgtataacgtgtaaggaaggggtccagtttcagttttatgcatatgacttgccagttttcccagcaccatttattgaataggagatcctttccccattgcttgtttttgtcaggtttgtcaaagaccggatgtttatagatgtgtggtgttatttctgaggcctctgttctgttccattggtctatatcttttttgatactatgcttaaaacagtaccgtgctgttttggttactgtaaccttgtagtataatttgaagtcgggtagtgtgatgcctctagctttgttctttttgcttaggattgtcttggctgtatggggtgttctttgattccatatgaaatttaaagtagttttctctaattctgcgaagaaagtcagtggtaggttgattgtaatagtatttaatctataaattactttgggcagtatggccattttcatgatattgattcttcttatccatgagaatggaatgtttttccacttgttggtgtcctctcttatttccttgagcagttgtttatagttctccttggagaggtccttcacatcccttgctagcttggtattttattctctttatagtgattcacactgattaatttcatcagtcccttcatataggtcagaagtttacccttttctcactacatgttgtaaatggacagtgactaatcatcatttccaagtgaatgacttccaaatctctgtgtctagtgttccagcccttcatttccagatatttattgtatatcctcttcactagtcatacagcacctccacacatctaaaaccaagtttatttctatttcaaaccagcagccattcgtgtggtgtatatttttaatggaccaaccattcatattatgtgagttcaaagccccagagctaactcctacttcttaagctaccctatctgctccatctaggaggagccttcttcatttccactggtcttacccttattcagatctttcttataatctcctgcaacactacagaagtctcctttcccctccttcccagctctgccctgtttgtagcctacaggttgctgatattaatactattactaatgcatagcactggtcaagctcttggtcatttatgtcaacttggtgaagtctagaaactacttttcctggaaccctctgcttctctattgttctgagataagttggccaagacaggactttgtgtgagaattggaagaaggaatggagcggatgccattgttcatggaagtttatcatggtaaatgatggtgataaaagatgcagaggtgcccgtcaggatccagcttgttcttgctctcatgcactgtgtgcccagcatattttcctacctgttggccccaacatcagccccaggctcacagctggatcttggatgcagaccctcagagacaggtgctgccccaggtcagcagcttcaccaggattggcagttccatccatctttctgaacttgtcactgaaggcatagaggtgggtcgagctcctctttaacagacacatgccagtggcagattgtgcgaggctccctgggttccttgcaggctacaccctaatgtggtctagctagtgactgtttgattcttcagtatatgccccttgcaaatcttccctttctcactttgtcccacaattgtgcagagtggatggaattctcatattaaatacttgatttacgcaatacttagagtggctgttttcatgattaaaacttgactaatacatatgccttgactttctttgaacacacacacacacacacacacacacacacacacacacacacacacttccttggcttgctgctgcttccaagtttggtttcaactctttagttagagactctggttctttttttgttttaacttttattttaggttcagggatgcatttgcaggtttgttatataggtaagttgcatgtcataagtgtttggtgtacagataatttcatcacctaggtaataagcatagcaccaatagatagtttttccatccttaccttcctccctccatccaccctcatgtaggccctggtgtctgctgctcccttctttgtgtctatgtatactccatgtgttgctcccacttataagtgagaacatgcagtatttgtttttttgttactgtgttagtttgtttaggataagggcctctagcttcatccactttgctgcaaaggacattatcttgttcttttctatggctgtgtagcattccgtcatgaatatgtaccacattttcttcatccagtcctaccattgatgagcatttaggttgattccatgtctttgctattgtgaatagtgctgcaataaacatacaggtgcatgtgtctttatggagactaattattttacctttaactttccagacatacatccctaccacttccattcaaaccctcatccaatcctattccattcaaatcctattctttctattcaaatccacaccatccacgtgacttccactcaaatctttattgaattccattcaagtattatctacttctgagattcagactatcccactatagggtcttactctctcttccttatctctacctgtagaaatcctacgggtcctggaataaacacacacacacacacacacacacacacacacacacacacacacacacacacattagagataggggtctccatatgttgcccaagctgaactcaaacttctcagcctaagggatcctcctgcctcggcctccctagatggaactataagcacacaccactatatatttttttttatctctgcttacttgattctaaaacatgttttagaacacatcatagtttgttttataattttttgcatacttttcttagtttccagtatgaataatcttaaggtcagacactaaaccttatttatctttgtgtatctcatagtgactagtatggtgcttcagaaatagaataaggtgctctttaaatgtctgtttagtatatggttcagtaaatattttttcatacccatttctttgcatattaaccaatgacactcactagagtttagaatgatattattttatactgactgtaaaggacatgctttttatagtcatattttatattatgaaaacattccaagagctttttccaagaatcttaaaatatacagagcttgataaatctcatgtaacttaaataataaatagtaagtatatattaaggtcaatgtactttcatattacattttagagtatgaacatattgttataaagagtatgcaatatagaaatgtctaaactaatatctactgaaaatgattacatatatgatgctagattatcttgaaatagaacattattcataacatttttatttataataaacccacccattgcaaggaaaattatgtgtttagtgtaaaaatcacagtatgctaggaacatgattcctatcctaaaacaataaaacatttacatgttgagagcaatttgtgtaaaggtagctccttcgcaggacaacaaagcagagattaaaatgcaactctgccctttaagcttaagacaaagaaatacggtttttatttattggataagtctgtacctcttttttttgtaaccttcaaactgatgaggattatgaaacatcaaaatgtcaccacgtgataagtgaaagtcaccattgttcataggaatcatctgagggtgccctgcattctgctaaatgacaccggcaactgtaacagctgtcaaaagtaaaggccctaatgatgctcataggcagaaatgctccctattcaataaaatagagctagtttctgcttacatttaagttcctaacttaagaccatttcctttcaacattaaaatagtcatgatgccttttgttattattgttcttattgattcagtgcctattgagtaccacgcactgtgataagtgtcttacattaattataagacatactatcatcattctatgagatgaggaaactgagacacagagtaacttattcaaggtcacacagctggttatgagaagtatgttatcctagactctcacatttaggcccaaattgtagcctcttaaagcctcacacatatcctatgtgctttagtgtctcaataagtttatttgtaataaaatgaaaagaaagctctttcttctattttaagtacatgaatcctagaatcaaaacttctggcaacttgaaatcttctcccagtaacctcactcaacacttatcgagccattaaatctcggctgcgtcccttggggaaggcactttacctctctgatcttcagtgtctgtatttttcaaattgggcataatggcatgaactttatcagttgttttggggtgagtgaaagtcatttatattgccctggatacatggtagtccttataaataagtcttctattctgagctaaggaatttggactttactgacaggcaatggaaatcctcaaataacacagcaacatggatctccctcgtgatctccctctcttcacaatcatgcgtgcatcaaagatgaattttctttgaacacaacttacacttttcataatacgactctctccctttgtagttgaaagggcttatcaggtttcctacttcacacagaatgaaacagaggtgttcttgtttggattgttccccagcactcctgacactagtgtttggcttcagttacactcatccagcagagtcccacaaaggagggtgactaactcatctgggtttgtctgggactttactacttttactcagtcccaaacaaaatgggagaggtggccagtcaccccaaagacattacactttcccaaaattccacacatttgacattgccctttgtgttgctctatcaggaactgcacatcttgcaaggcttaatttagagccaataccatcatcacctggggtaactggagcaggtggcaccgatgggagaattattattgagtttaataaactgggatctgatgttgaaggtttttaaaaagtagtttgaaataaatattaaatacaaaaagtttcaatactagtacaaagaatatgcatacaactttcacccaggctcacctagtattaacatttcaccactttgctctatcatttgtgttccgtttctcacacacatataatattctttagatggggaaggtttacaaaattttatcatatgctcagaggtagggaaaatcacttctaaccaggaggaagtaatggagaaactggctttcagtaaagatttgctgggaagtcaaatgttcagagctctgcttgtggaagatgacaactacaagggtgtccagtgaagtctagaaagaaggccaggctggagacagagggatcagtcaggaagctgctcagaggtccaggcaccaaggacttctactaatggacagagatactgatgggtttgagcaaaaataaaataatattcttttagtgcccaagttagataagagtgtctcacattttcttgactatttgacctaacttagtaaggtgatttacgtctaggatttttcacatctcttttataaaatagagtcctttgatcacatccatcttctcatcttggttgtttataaatgaaatgttaaaatgaaagattatgggaagaattagactcctgttatttcatgtgatgaactcatttcttggcagagttacactggatgagttaagatgtaactgaaaatatgcttccctcctgaaacttggaatcttgcttttaattatcattgaaatgtcaccagagatacatttaaacagtttttgataagacatggactaacaaaccgaatccaactgctacagggacattttttaatttcacaggtggttgaaatatatactgcggcagtataaaggagaaaatgcagcaggagctacccgtgataggagtcaatacctctgtgaacaaggagaagcactactatcttggttgaaaacactcttattcgtaacaaaaccgaaagctcctgtgtctgatcttttaatagactttcaaggacacattttcaagtaagtaccactatatctggacgacaatcaacctttaatttctttcctttattgttcctttaagtgtctttggatttcttcttttttttttaaagtgtctggtattttgacattctcacttctcacatgggctgtatttatgtatggtactcatcaacaaacacatctacagctttcggtagataatgttttgtttgctccaaaaaaagaaattaggggagcccttactgagaaagtaatagcagtactactaataaatatgggagctgttttcttccattagaagaaacaccagtagcaacatatgtattccaatctgtagcactaagtgcactcaattaaagagaagatgatagcgatttgcagatccccctgctccagcctatttttcagttggcatggtggggactggctagggagaccatacccatctttccaaagcaggagtcgggaaagacttgctggtagcttgaagctagccgtggaaaaagtgcatgcactgcagaaactggcaaatattaccaaccttttttctgacagcaggtatgggaaaccagaatacgctacacccaaatgtgcctctttggcagaagtctgattgggctgaaggaattaagaacaagcagaagcaggaaggctctttgccctctctctatttgcctaaaattgggatgtaaatttacaaagacaaaagctatttcacctcccctctctgaaagaacaaaggttaaccactgaagagagtttttcacccttacgggccggaagatggcaccagaggaaactacgttagcaagctttgcaaaccagcctttctctgccagttattttccttcccccaccttgtggcccctagagatacaaagtctttttattttttattttttttgtcttgtcacttctctaagcattgactgttctttgtagaagatcccacataagttggaattcaagccacctctttgaaaattactcattccctaggtatcttccatgcgtgtattaaataaacatattaataaacttctgtttgtttttctctttttaaagtgtcttttgctatggggtccattccaacttaaaacttatcagggttgagataataattattcttcttcccctacactggttattaaatgttgccaccacactagcacctacaaaggatagttgggttttagaaatgctggaccatggacaggtagaatcaagtgaaataataatgtgctgcccttaatgaagctgttgtctgtcaatagttgataacaccgaattcacttcataagggtagagaggaagaaaacaatgtttgcaggagattgtgaacaaggaaggaacacatttcagataagggtaatcatagctgggctccttaaaatggcaattataaacatgtccctattatttcaaaggtaggccaatgactgatggttacagaaacatgagctaccaaaacagaccatcagaaaccaaaagaaaaaatatgtgaacaaaacagctttttaggaagaaaatacattaaatcaaattcttggcattttgaatatgcaagaaaattaaatatacaagtcatactgaaaactgtcagtcctttttgtgcatagcttgatgactaccaggcaaaccattttccctaattgagatttaagaaaaatagacgagtttaactctagtgcaaaataaaatgacttaactgacaatgtgagaggctaactgaagaaataagaaatatttagaaagaagagagatataccaggatttcatagattacatgagaagaagcagactaaagggaacatttcattgtatattatttctctctatatatgtctatcaaaagtaggcatttcaaaaaatcaaaaaattatttgaaggtacaagccactttattgacaaaattaccttttgcactataatttaactttcttaaacttttgaccttgtttcttgacctttgtacattttccttttcttttttaaattatgtggctcctttgagtcatccatttcctctttcctctggaaagggaagagtcatggattccaacctttctgctagaagctacgaagaattaattgccatgtaggtttccttggaagacgtcagataatctttacctgggtttcatgcacaatcatttctttaacaagactgagcattagtcatacctataaattaattctccctcttggtctaaaactaacatctgaaaatactgtacttttccttcacatcaaatatggcctaagtagccttttcattttatttttccagaaagctttcccagtaaaaagacagacccgagggtattttctcatcttgttgcagagagtgatggtacagaatgtgcataatgcccacgcaggaaagttaataatattctacaagcagtctatttttagattaatagagccagtttacgcaaagcaaatctgtactgcagaaagaagagcgttaaatatttgaaaaaattctggataaactttaagaaaaaaggaaacattttcttttcctacattgggtctaacataattaaatgaattcaaaggcttagccacttttgcaaaggcttaattgcttgtattgatcgtgacctaaatttgcttctgcacagtttatagagctacatttggcactggaaccaaaaccccttgggacgaaaagccatagccatcctgacattaccaaatggtagaataattatttacatttattaacatggagataaagatcattttgttggttgaccagataactaggtctttcctggctaatgctgcattaaaatacatagtctcaacagtcaagaattctcctagtgggctttggtagaccataattttagttaactcagagaagaaaaatccctcagtgtaaacactgggtcattattttaaatctattcaataaatcggtatcgtacataaccctcacagacatgccgatttcgttcaatggtatttctaatcaccgataagcctatatagagagtaaacacactacccaggatcctactacttggataaaaagccaacatcaccctgcctttccttcttttaagataaaagggaaatcaatgagtttttatttttattttttaggagtgcaatctacttattttgccatactaaactaaagttctgggatcccctgatacttgtgcaagttaccgcatacacatctctgatggatgaaggaatgtttcttccattctaagcaccctgcaaaagccatttatattctgaggcctgaactatatgcacctagtgtcctgcactgtcactcagagattctttctcttcttccaactactccctgactcctttgatgttctatgaacactttaatacgttagagatcacttaatgcagttgattttaatgatctgcacacatccctgtcttcccactagactggatactttcctagttatcttttcctcattcatctttttattcccagggccctcgacagtgtctgttaaatactatttaccttaatatttagtaaatttgcaaaaggtgtgagtgaatgctccttttttctaatattttatttttaaaattagctttaatattaaatacaataagacaagaataaaatttggtttctattttaaacaagattttcatgaagtatttgaggttttttttttttaacttttatttcaggttcaggggtccacgtgcaggtttcttacgtaggtaaacttgcgtcatgggggtttgttgtacagattatttcaccacccaggtacccaatagttattgtttctgatcctctctctcctccaaccctcgactcccaagtaggccccagtgtctttcattcgcctctgtatttatccatgtgttttcatcgtttagctcccacttataagtgagaacatgaggtatttcattttctgatcctgtgttagtttgctaatggcctttggctccatccatgttcctgtaaaggacttgatttctttcttttttatagctgcatagtattccatggtgtacatgtaccacattttggacatttgatggacatttaggttgatttcatttaggttgaatgccattgagggacatttaggttgatttcatgtctttgcaattgtgaatagtgctgcaatgaacgtttgcatgcgtgggtctttatggtagaacgatttgtattccattgggtatacactagcaatgggattgctggaacaaatggtagttctgtttttagctctttaaggaatcatcacactgcttttcacaatgattgaactagtttacactcccagcaacagtgtattagcattcccttttctctgcaacctcgccagcatttgttttttgactttttaataatagccattctgaccagtgtgagatagtatctctttatggttttgatttgcatttctttaatgatcagtgatattgagtttttttcatctgcttattggcctcatgtatgtcctcttttgaaaagtgtctgttcctgtcacttgcccactttttaatggtggtgttttttcttgtaaatttgtttaagttccgtatagatgctggattttagacctttttcggatgcatagtttccaaatattttctcccattctgtaggttgtctgtttactcttttgacagtttcttttgcagtgcagaagctgttaagtttaattagatctcatttgtcaacttctgcttttgttgagattgcttttagcatctttgtcatcaatctctgctagttcctatatccagaatggtattgctaggttgtcttccatggtttttatagttttggcttttacatttaagtctttaacctgtctttcattgatttttgtacatggtgtgaggaaggggtcaatattcaatcttctgcatatggctaaccagttatcccaacgccatttgttaaataagtaatcttttccccattgtttgtttttatcatctttgtcaaagatcagatggttatagatgtgtggtcttatttctgggctgtctattctattccattggtctatgtgtctttttttgtaccagtaccatactgttttggttactgtagccctgtgtaccatttgaagtcaggtaatgtgatgcgtccagctttgttctttttgcttaggattgccttggctactcagggtcttttttggtcaacatggattttaaaatagtttctgtgaagaatgtcattggtagtttaataggaatagtattgaatctgtaaattgctttggtcagtatggccattttaatgatattgattcttcctatccacaagcatgggatgtttttccatttgtttgtgtcttctgatttctttcaccagtgtcttgtatttctcattgtatcactcacacctcgctgattagctaggtattgtctttctttggtggcaattgtaaatgagattgtgttcctgatttggctcttggcttgactgttgttggtatataaaatgttagtgatttttgtacgttgattttgcatcctgaaattttgctgaaattgtttatcagcttaaagagcttttgggtcaaaagtatgaagttttctacatatagaaccatttcatcggcaaacagagatagtttggcttcttctcttcctatctggatgccctttatttctcttgtctgattgttctggccaggacttccaatactatgttgaataggagtggtgagacagagcatccttgtcttgtgccagttttcaagaagaatgtttccagcttttgcccagtgaacgctcctttaaacgttccaagatattgatcccccaaaatttgtatttaaagtgttaattttctctttgaagtgtcttaatattttatacatagattttaagtactgaaatattaagaactaaaacattttctacagaaacttgccttttcaattcttagtacattaatattgtgtgtataaatgcaaatttataaattcagttagatgaaaagcagagtatgattagtatcatccattttctgtattgttgctgtgagatctgggctatttctatgcaaagttatcttattgaaaatttgactaaagaaagtaatgtgggttgttaaataatattttaaattaaattgtcagctgggcgtggtggctcatgcctgtaatctcagcaatttgggaggctgaggtaggtggatcgcctgaggtcaggagtttgagatcagcctggtcaaatggtgaaactctgtctctattaaaaatacaaaaattagccaggtgtggtggtgtgcacctgtaatcccagctatttggaagtctgaggcacgagaattacttgaaccctgggaggcagaggttgcaatgagcagagatcgtgccactgcactccagcctaggagacagagtgagaccctgtctcaaaacaaaaacaaaaacaaaacaaacccattaaattgtcaatttaattttattgttttaagaaaaaattctataacaaatttaaatcaaaaggacattggcatctgattatctttccctccttgtttttggtgataaaatttcaaaaatttatgttaccaatttttgtatttccgtgctctaattggtttcatcttaaaactctgtcattacttttcttttatctctatttatttgataattcagtcgttctagaatccactcatttattcaatttcaaatatttactgaaaatatgttaggcaatattattttttaaaatttattttaagttccgggatacatgtgcagaatgtgcaggtttgttatataggtatacgttgtgccatggtggcttgctgcacctatcaacccgtcatcttaagccttgcatgcattaggtatttgtcctaatcctctccctccccttgcccctcacaccccgacaaggcccagtgtgtgttgtttccctctctgtgtctatgtgttctcattgttcaacttccacttatgagtgagaacatgtagtgtttggttttctgttcctgtgttagcttgctgagggtgatggtttccagcttcatccatgtccccgcaaaggacacgaactcattctttcttaaggctgcatagtattccatggtgtaggtgcgccacatttcctttatccagccagtcattgacgggcatttggattggttccaagtctttgccattgtagatagtgctgcaataaacatacgtgtgcatgtgtctttatagtagaatggtttactcattcatataagctatttcatattctctttgcaacatgcaaagcgtcacataaagtcattgacagattaaattaaatcaaataaatttacccagaagaccttttactcactggatttctttactggagatatttttgaatgatgttgtcatcaatgttttattattttgtatttaatcatattcaaagttcatctgtctcactgtaaaaactcttaaaaatgataattacttttttatgttcttttctgatttgtacgataatgaatgctgtaaacatctaagaataccatcagaaataagaatttcaattttgatgaacatcatctccataaaatgaatgctttataactagggcctgcttgttaccaatgagtatgtattatacatataaagataatggaataatattttttcttggtaatttccaattgttgttgatgtgatttttatttttatttcattaggtccttcccagatgttgcaactttttattttctttctgttttgattactggagactattatataagaacagttgtagcttaaaagtataagtcttaataaaactatatcatatttgggtttagaaattttaacttgcacaaccaacaggtcatctaagaagtgagcattgaaactacaaagctctgatgagaaaaatcaaagaaggtctaaataaactgaagacatattaagagggactcaacattcttaagatgccagtttccccagctcaatcaacagattcaatgcaatcccaatcaaaatcctagaaaattactatacagatataaacaaccaattcctaagtttatatggaaagacaaaagaaccagaacggtcaacaaaatattaaagaagaaggaagtcagaggactgacactatccgactaaaaacgtactgtgaaactacaatgattaagacagtacagtattcatgaatgaatacacaatacatcaatagaacagaatagagagcccagaaacttacccacacaaatacaatcaactgatttttgacaaggaagcaaaggcaattcaatggagaaaagatagactggacctccacatggaaaaaatgaatctagacacagaccttagaagcaacaggcgctcccatacattgttgatgggaatataaaatggtacagtcactttagaagacagcctagcagttttatgcaaaccttatcaaaggcttgtgataacatacagcaatcatactcctaggtatttactcaagtgagttacaagcttatgtccacacaaaaacctgcacacgaaagctacaagcaaccaagatatcctttaatagatgaaggaataaacaaactgtgatatattcatgcaaggagatattattcagtaatgtgaaaaaaagagctatcaagctactaaaagacatggaggaagttgaaatacatattatgaagtggaagaaggaagtcttaataagctacatggtatataatttcaactatatgatgttctggaaaaggcaaaactatagatacaatgaattgatcagtggttgccaggggttcagaaggttcaggggaaaggataaatggttgaagtacaagaaaactttagagcattgaaactttgaaactattctgtatgataatacgatggtagatgcatgacattatacactcgtcaaaatccacagggtatagaacacaaagagaactctaatgtaactatgaactttagtgaatatttatgtattaatattagctcatcaattgtaacaaacgtaccttactaatgcaagatactaataatgggagaaattgtgtgcagaaaggaagggattatatgggaactttgtactttctatacaacttttctgtaaatctaaaacttctctaaaaacaaagtctatttttaaaagtatatagttttgcttgcttaacccgttatgattttccaatgagttcttgtgtctaggtttggagctatgaataaatggcagtcagttttctgtccacataagttccaaggactataatatagtttttttctctttaaaatacaagtaaagttttaaatatttttccagaaatacaactcagttactcttcaagtttgaaaagttattttcattttgaaatatttccaagtataataatcttatgtgaaatacattaaataagaaactcatggcttaaaggagtcttttcattaatcccttaatttagaaagagaaagtatctagaaagacttcacttcacataaaccctcttaccaaaagttgcaaaaatttttttcattcatggacgtatacctgaaattgatttttttcctttaaacaatcattttgctacatctagcacatcaagatatgtttgccataacgacagatgaaaatgacatttttctcttcaggtttacattgattttgtttctacacatttcacaactgcatcatgaattttttgattactctataagtataagcatatttctaaatgttcctttaacctagtaattcataccaaagacttctttatatacattttcctttacatagagcctaaatactaaatgatgaaaaccacagatatgctattaattagaagtctgccagtcctctatagtacttccataagatttaattataactcaaaaatatatctactctttccattcgcaatacattatccaagctgtgactatctctttcatgggcaactgtaattccctcctaactgttctgttttcattttttctcctttctagtccattctctccagagtggccatagtgatctcacctaagcacaatctgatccatcacatttgtgtcaaaatcctccgaaggctctaagcatacagtttactcttttctcccctcctctgtggctaattgtcccccattcttcaggattcagcttcaatgtaactccttagggaggcacattctaagcctctgtagtgtaggtcaggacacctcttgcagtctcaggatgcggtgcatcctctagagcacttgtccaactgcaatgactcagtgatttgtgtaattacacatttgctgttcatttcttctaatggaatgagagttccatgggtgcacacaatgtatatctgtcctccaaacctaccacagggcccaccacatatatgcccaataattatttcttaaataactaaactaacaccaagagaaccctgaagcaacactaggactcatagtaaagatatgacaaaggggaaggtgtattcaaatttagataatataattaacataatgaagaaatgacttcatcaatatagttggtgtggcacatcctttttctcctgatcataaaaaacgcccttatttataacatttctcaagggtaagggaggagagtcctatttctcatgatacctctccttttatcctcagaaaagcatttaaataaaaaacacaaaaccattgtctgaatttctgttctgctttaaagtgcctgatgagccagttgagtaaaagaaagtagaatggcttatgatagaacaatgatggcttgtcaatgcacacctttcaaagaaagaatgagactatcataagcatgtcatttgataacgactgcaactcatccttcctccccaagcagccagcacttagaaatagtaatacaataaatttaatttaaccctaaaagcaaagctattattggaacgtacttatcctgtaaccccaactaacttgaagttcccctctaccctgctccgaaaggtatgccgccaaacacaattttatcagcctttgtaaatgtaacctcttttgatctttcctatttctatgacagtataacaatattatgtgcccctgagagggattaacattaaagtcaagaagaagcagccaagtgaagatctagaggaagcaaattccaggcaaataaaagaataaatgttccctaaggtagggcaatggaaccaaatgaggccaatgtggatctgcagactagaggtgaggttagagctgtaaggagatgccaaatcatgagctttgtaggctcggggggaatttaggatatgttctggatacagggttgacagaagttgttcacgttggaagagaggcaaagacaggaattaccttctcattgaagaaaggtactgataatccaaattccagaaaaagacatcttaatccacttaatcttgaagggtattgcaaaactacataatatagtagattttcatacctttctttatggacattcactttaagtttctaatgtttgtcatttgcgcaggctactgcctgcattgatgagtcagccactgaatagaactagaattcagtgttatcaagtgcattggtatagtccatgagatttgttaaggactcaaatgctaggacaataagtcttctcaggagcatgctgcagagaagagactcagctggacgtgggcctggcctggatttcagtactgatacacggccagctctggctagaattcatatttgatctcattttttatatgtttaccttatatattccaaattttgcatagattattgaaactaggtcaaaagtaaaatcatcagttaataatttatgacacttctgcaatttgtcccatccaaatagaacggcctagagaaactctgtggctgtatgaaagttgagccaacatcacaactctgtgaaactgcccaaaaacaacagctttgggggaaaaaaacagtcaaatgctaggctgccaccaatttccatcctggaatctacaaaaagactcatttaacaatataaaatgaaacaattttgtagtttttggttagaaaagacttgattacagaaacaagcatatcttgtagaattttataaatggatacattttttatggtatttggagaaaaatatgacttctgttagtgttttataaatattggctaaaaatgaaataatgaacttgagaagggaaatccagagaaagctaaaagctagagttttgcatattctcttctatactggcactttgctttttctgttttgaatatattttcaatgccccagtgaacttggtaacactgccaacaataaaaaaaattgtaaaggacttagatctttaatataacgtgaaaatctggaaattaaacagaataacagagatgaagaaattaattttcagattttttaaaaagatttttgctggcccctatttttctattataatttcaaaattttttttcaaattggtggctacatgtgcaggtttgttactcatcctgtaaccccaactgttatatgtatattgcctgatgctgaggtttggggtacaattaatcctctcacccaggtactgagcatagtagccaacagttggtttttcaactttgccccattcccttccgcaccagtagaccacagggactactgtcgtcacctttatgcccatgagtacccaatgtttagcttccacttataactgaaagcacgcagtatttgggtttctgttcctgcgttaatttctttaggataatgttggcctcattttcctaagattaaagctgaaattttgaaatatctcttggtattggtgaaaaatactgagataaaaagattaagatacacatttattgtccaatcattaaatcattagctttattacagataaaatattatatcgaattggattagtaaatttaaggccaaaccaattttgaaattgttcagaacttacatcaataaaggcttcccattaacaattttatatgtataactctacatatgtgtgagagtgtacgtatttttttcaaaacatagcctagtgtttttatttaatatttcctagacttataaattattttcagctaacatctatttagccatgaaaatacaataactacatagttattttgaattataattctggcttatttaacacaattcaaagttatataccagttttgaaattttaagataccttctatcatttaatagagtctataggtgtatttcactttttaaaataaatatttttgagtaacaaatcataactgtatacatttatgggacacaaagtcacggttttgatatatgtatacaacgtggaatgattaaatcaagccatttaacacagacctcacctccctcacctatcatttgtgtgtgcgtggtgagatgtttgaaatttattcttttactttgaaatatacaatacattattgttgactatggtcaccctgatgtgaaatagatctaaaaactttttcctcctgtctacctgaaactttgtaacttacaaatatcatttgaagaaaaaaaacccaaataccaaaatatttgaaattgccatcactaatgattactgttttaaatatttggagtgtagtttagaatactacagttttatctacatgaactctagaaaattttgtctctgtgcacttgaagccatccagattaagccattcccattcaagattcatgagacacagtacaatatatgagactttgaacttttttttttaacttcgtgagcaactatgcttggataaacaagccatttgaggaaacaatacgcatctttcacaactactaagcctacgaataggcataagtggagtaagctccagctgcagtagggactttgttgtctggttctagtcagccccaattgtcttgctctaaaaatgataaaagatgcgaaatttgcatgctactcaaaaggactggttttaaaattgccattcaactatcgggtgttattgtttttcacagatgactactttttatctatttattttttttttgagatggagtttcgctcttgttgcccaggctggagtgcaatggcacgatctcagctcacagcaacctctgcctcccgggttcaagagaatctcctgcctcagcctcctgagtagctgggattacagacatgcaccaccacacctggctaattttttgtatttttagtagagacagtgtttgtccatgttggtcaggctggtctcgaaatcccaatgtcaggtgactcacccaccttggcctcccaaagtgctgggattacaggcatgagccatcgcgcccggcctgactacttttttgaggaagaccctattctgcacaacagaggacatgtttgaagagggagtttacagataaaccttaggaataagaaaaacagggcacagataatccagtctgctgtgtctttgttattgtaatcatcagttggttagctggttctcatgcctgtgggtgctaagaagggtgagatcaaagaaaatccacatgggactggtgctccttcatccagtgcttcattcaatacttatcaatcatgcaccaaacactgctgagcatcaaaagtccatctaggcactgggttgtcattgtgaaagggacaggcagggtgtctactcttacggacattacagtaaaggagacataggagagctcactaaagtataaattgctacacactgaaaacaggccatggagaaacggtaggtaagagaacataagggtggaaactgaccttgcctgagtacaggcaatgcttccatgaacactatgtttaggaaatgaaatgaaagttctctgcttccaacttcaaaaaacaaaagcaaaaatgctgattgccatgtgggtgttatttgcaaagtttcacacagtattcatgtattattcatttataaaaacactgcttactacatgagcagtgcctactcaacacttttggcagtgtgaatgcgacagacgtccacttccaacacgcttactgattagctggacagaaagatttattactctgtacacagcaggatgtgctgagaactgatagaggagcaaagaaagccagaaacagcacaagagacatgtgaggacactcccagtgacaaagctactttgtgcggtgcatagattctgttgccattctttcttttaagtaaccttatttctggctttgttatgtgtatacatttatttcatttttctcacttctatctcatttaattacagagtgttgtatatgtacacatttttgtgacacatcttaaaacttttcacaaagagaagcacaattaaataaatattaaaagaaaattagaaaaataaaaataaaagaggctgggtggagtggctcacgcctataatcccagcactttgggaggccgaggtgggtggatcaccagaggtcaggagtttgagaccagcctggccaatgtggtgaaaccccacctctatttaaaatacaaaaatcagttcagtgtggtggtgggcgcctgtaattccagctacttgggaggctgaggcaggagaattgcttgaacctgggaggcagaggttgcagtgagctgagatcgtgccattgcactccagcctggggacaggagcgaaactctgtctcaaatttaaaaaaaagtaaaaaaaaaaaaaaaaaaaagaaaaaaaaagaaagaggcagcaacccttccagagaaaggcttcccaaatgagaactattcaaatatagaaaaaagtacagagataggaaatataaagaatctgatcgagaagaaggcatgttggtaaactggagtacaatgccctggggtgggtagtatatagggcataaatttagcaaaaattggttgatttcaaaatacagagcatctagaatggtagacaaaagagtttagatgtgagtgtctggcagtgttaggggagtgacgatcaagtctgtattggaggaagataacaatggtggcattgtgaagtggcagagcatgaccagattgataggatttgacaagggggacaagagagaagacaaatttaaagaagttccaaatgcttctagcctggactactgagaagacagtaatgttttaatgggatacaaaagagagtagggacaggtatggagcgggatgatgggtgccactccagacaagctgcccacagaatatctaggctggaatttccaaaagaggttaggatgcaaacctttaggaatcatttatctgcaggtgtcagctaaaaccccgtgaatgttagagatgaagtagggagaaattattgaatgagaagagtgggcatccagcacttatttcccagggccctcatagttgccacaataccatacatgggaagctgaaaagttttgtggaaaaagatgtttaaacctattcttgtggccaggcgcggtggctcacgcctgtaatcccagcactttgggaggctgaggcgggcggatcacgagatcaggagatcaagaccatcctggctaacccagtgaaaccccgtctctactaaaaaaatacaaaaaatcagccggggcgtggtggtgggcgcctgtactcccagctactctggaggctgaggcagaatggcgtgaatccagaaggtggagtttgcagtgagccgagatcgtgccactgcactccagcctgggcgacagagtgagactctgtctcaaaaaataaataaataaataaatgaaataaataataacaataataaaaacacctatcattggatttctaagagatggtcatggcctatttgagatttatctcccatctgtggaagaagccagaacccaagaggatctcaaataagggttttgtcaatgaaagcaatgagctctgtccccaaaggccatgataacttgtgtttctttttcttcatttaggtactgtaatgggtccacgaaacaattaatagatattattgagaacatatttgaataatgcacatttaacgcatcagacagttgtcaccctttctaatcctttaaaaatagtttaggatggtcatcgataatattatggaaactttttaatctcgaaaatgaaacccatatatttgataggatgaatgagttggcaagaatgtcagtaaattgcagttttcaaaattttatctttaacatcatttaatctgccagaaatttaacaagaataaggataagagattggcctcaaggtacaattcatctttctcctcatattccttgtaggtgcatatcaaatgatgtattacattctgcagtttttggagaatatatttaaaattaattaaggtagagtcactataatccttttaacaatgtcattcttattaacttgcattgcagtgggaggcaaatgccacaacctctgtggctcaaaagaaaagcaggcatcgtagtgagaggtgtgcattgtagtgggtggagggccagcaagaggctgctctgctgcaagtgctcatcagtcaaaatggagctgcagctggaaccttgtgtggttttacaagaaggagccctacccctcacctactctactttttattggcaatgaataatgagaggagcatttgcaagtgtgaaattggaaaagagcggaacatcagcctgaggctgtgtgcaagctgctcggggagccagcagagaagcactgctgatcctgcctggaccttctgtcctggaggagggtgggcctcccactcatgctggttgtaaacatctctgtcttcttgcttgccttcagacatcttctccagcgtggcgtaaagaaagagtgattgcaagcatattatatcaacgttttcattaattttagtatgcctttaaaaacatttcaacactatgaagaatacttataatcaacaacatgtcatcgtttaattggaaacatttttgtattctgactcattggtacatagtgtgtattttaccatggatgtcagatttggtgaattaagataactgtgaataatcctggtcatgccaatgagaggttgtcatccatgttaatatcttctggcatatgtgaactggggaaactgttctcccatttacccactgccttaatataacagccacatctacagggagactctgacttctggatccgcctttagaaattaagcatttttggaaaactatgtgatggggaaattactttaatgggttagctttaggaccatggaagagataagaagaatgcaaggtgttttgcttaattcttagaggcagttttccttcctgaaaatgttggcattcttgatgttataaaaagaatgtaagggtctccttatggttgaaaacaattcccccaagagctttacagaaaattgagcagcatagtgatagtttggctccccagataaataactgtgtccttcaaaatgtcctacatttcaatgtatttttcactgtcaaaattatgaaatcatggtctcatcatccaaatagaactcttagtattatggatgtatttccttccagtctgtttcatagccatattttacattgttattgtatgtatacacagttttttatcttgtgtctagtctgctacaattggattccaagtattttctgagtagtattcagtattcgtatgtttgtataatatttcctcctcaatatttctaatgtaatttggagatatttgtaaagatgtttttgaaatttttattaggattttaacaaatctgtcaaattatacagaattaaaatatctatactatgtaccactctttcagaaatatgccctcataatttcagttattcacatagattctttgtaagtcttactaaaatgattaccagatttttatatacttttgccaccataaataaaattattttctattttattttctaaaagaatgttcacaaaattacaattgcttatttataatattctaccttgtcaagttaccaacatcttattaattacaatttagttgatcccttttgatttataagatatgtaacatcactcacaaagaaggacatattttgctgttcctaatatttatacctaatatttagaggaataaatattaaatatttaatactttaaaatattaaaaaaaatattgtgaaaatattaaaattttttactacaatggccagaactttcaaaacaatgttaaataattagggtgatactaagcaccattatcatacatttattttaagacaaatgccaccaatacttcacagttgaattataattgactaaatttagtatatgctaaaactagggcaattcttgtccttaatttctacatgtaaatatttggtcacaatccttatagtgatgttacatcttgtaaactacatttccgtttatctgacataaaggatttatttcagaggtgggaaatatagggatcttgtaggccttcgacaaattatcagagtaacttcagttttatttccacaacttcacaacattgtaatgagaatctgctctgctcaactcctccactagactttaggtaaaatttgattagattctagatattagtcccttgtcagatgtatgctttgcaaataccttcttccattctataggttgtctttctgttgacgacttttttttgttgttcagaagctttttagtttagttcagtcccgtttatttattcttgcttttgaggcatttgcttttgggatttactcacaaattctttgcctaggccaatgtccagaagagtttttcctccagaagtttttatgattttaggtctttaatccatcttcagttagttttgtatatgttgagaaatagggatgcagttttattcttccacatgtggctatccaatttttccagcaccgtttattgaatagggggtcctttccccaatgtatgattttttcagctttgttgaagatcagttggttgtaggtatttggctttatttctgggttctctattctgttccattggtctgtgtgtctatttttgtacctgcaccacactgttttggtaactatatccttgtaatataatttgaagttgggtaatgggatacctccaactttgttctttttgcttaggattgctttggctacttgggctttcaaacaaatcaccaagaaaaaaaacaaagaataccattaaaaactatggaaaagatgtgaacagacatttctcaaaagaagattatacaaatggccaaaaaacatatgaaaacatgctcaacatcactaaccatcaggaaaatccaaattaaagtcacaatgagataccactttaccccagtcaaaatggccattattaaaaagtcaaaaaccaatagatgttggcatggatgcaatgaaaagcgaacagttatatactattaggggaatgtaaattagtacaacctctaaggaaaacagtataaaagatttctcaaaaaacggaaagtagatctaccatttgatccagcaactccactactgagtatctactcaaaggaaaataagtcattatgtcagagacccctgagcttttatgtttattgcagcataattcataattgcaaaaatatgaaatcaaccgaagtgcccattaagtgattagtagatatagaaactgtggtgtgtgcgtgtgtgtgtgtatacatacgcacacacacacacaccataggatactattcagccataaaaagaataaaagaatgttttttgcaggaacttggataaaactggagtccattttcctaagtgaagtaactcaggaatggaaaaacaaatactgtatgttctcacttataggtgtgagctaaactatgggtacaaagaggaatacatagtggtataatggacactggagcctcagaatgaggaagggagattccaaaattacctgttgggtacaatgtacactacttgcataatgggtaaatggccagacttcaccactattcaattcattcaagtaacccaaaaccccttgtacccctaaaactattgaaataaaaatgttttgattagaaagatagactatatccaatagaaagatcaaagctagttgaaatcaacagtgataaaaccaacacattatggcaagccaggaatatttctaaacatttaaaagaaaaaaatcaagtatggattttgtacttgatattaatgaaaagtaaaagatgcaacattacactaatgtcagcaactattcactctcagttttttcaatctacatggattcaggaatgtttaacaaaattcatggtattttataattttactctttttctggcagaaggaagacaggagtggttttacaataagattttaccacttctgactagaaagttttatcctatattattccaaaataaacattctacactaaataaatatcttttgacagtaaaatgataatttaaatcatgttacattctaggaagtacagataaacacaggcagattttctctctgaattagtccttaaatcacctgattaaaatatgatactcttggccaggtgccatggctcatgcctgtaatcctagcactttgggaggcagaggtgggcagatatctaaggtcaggagttcgagaccagcctggccatcatgatgaaacctgtctctactaaaaatacaaaaaattagctgggcgtggtggcgggtgcctgtagtcccagctacttgagaggctgaggcaggagacttgcttgaacccgggaggcggaggttgcagtgagatgagatcgcgccactgcactccagcctgggcaacagagagattaaaaaaaaaaaaaaaaagatactcttataaaagtgtgttattttaaagcataaatatagtataaaatactctctagttgcaagaatgcatccttgaaatattcattaaatattttctaagggcccacatttgtcatgaggaaatattttaagaacgggtagaatcgagttccatttttcaaatctttaatatagaagcagatatcaattaatcttttaaaaacacaattttgtttgccatgagcttttatttgggcttctactttgacacatgttttagctttaaggtatcttaaaacgtaggggcatttaagcttttagatctcataaaacttcctgagaacatgctctgactcagtcaggcccagaaaacaaccactctttcttccttttctccctccctgaaacatttcctgagggcctctctggttcatggtaacatgctaggctcaggggaacacaatgatgactaatacaacatggtacttggctttggaagttcataggtcagtggaaatgcagaaatatacacatctaattacagcacaactcagtaagttcagtaataaatgtatatgaacacagggtgctttgaggcacagaagagcagcttcctactcagcccgaggaggtcagaaagaactcagaagaggaggcactgaattaatgcttcagctgtttttcaaaatgctttcctggtagcatctccgcaaacacaagaagcttaggatttaccatgcttctagatttgactgtcaaataacacatggtccataattttaaatctggttgactacaaaactcttcattgtgaaaataggaagtaacagaaacccagtcattatgcattcatcttctataatatttaactcggcttaatcgccataattctttcaactgtctgtacataatagtgtcaataaaactagaagagtttgaataggtactaaggagcaaactcttttaagataatcttctttttaaaaaatggtactaacagcagcctcaaaaacacagcagattgcttcgctttccataaaatcaggacaagaaggttgttattcttttcattctccagtaagctcaaaaggtgggaatcttgccaagacaactcaatgggcaggaagtcattttctcaggaaatttcaaaaatatcattaattcactttgatcttttacaatgattataaaacattcataaggatggctgtatctagcagttttaactgacaggactgttgtggttttttttttgtttttgtttttttttctgaccgcagtgcatcacattaaaaacaccctccctcctcaccatcaatttcacagtggaaaatccaggcaaagtgttttattcttgcttaaccttgaaagatatatggtgtgctcaattgaaaaatctattacttaattagttttaagaggtttgacatcaaacaggaatacatttgaaatgtagatgaagtaagaggtaaaaaaaattcagtttagaattgtaaagggacatgttggatgttccatgaaggtcaaagtcaattcctttccttaagttccctcaaaagacttatatgcacggaagtattcagtggtggtaactgaggtgagccttttcccaatttttttttttttttgtggtttgttttctttcataatccatttgaactttggcttgactcttcttccccccaacatattaactatccatcatacataataattttgaaatctgctttctaactgattgcttaaggggaaaattaagattaaagataacagacaagaaaacaaataattaccagggagtactttcagtgcttcagtgcagaatatacaagttgctgtgggaaccctgaaaagcatgttgacagatgcctgaggaggtaataggaagcttttcagaagtcacatgtgaacatggcctttcaggatttgtagatgttctcgggaggttaagaggagaaagagtagtatcagaaaaaaccacatacaaaccagcacacatacacagtaggtgagaacaagtggtcctttaggagatctgaaggggtgccatggtggtgtgtgtctacggcatatggcactaagtggatgggataggagggggcgatgagaagctatggttggtctgtgaaggatcttgcaggttatgccaatgattgtagattgtatcctttggacctgcactatctgatatgatagccactatctacctgtggccatttacatttctttctttcctttctctttttgagacagggtctcattctgtcacgcaggccagcatgcagtggtgtgatcacagttcacagtaaagtcaaattcctgggcttcagtgatcctctggccttagcctcccaaactgctgggattataggcatgagccaccatgcccagccttaaatgtcaatgaaaaataaatacaccaattcagttcctcagaggcactagccacatttcaagtgctcaatagccacatgtgactcatggctatcataatggataacacagagaatgtttccatttcaccccaaatactaatagacagtgctgcttaaataaggagaagccacatacaatcgctaattgtaaagtaagagattgacttgatgaaaactgtgcttgatgaaagaagtaactcatgtagtgtgaaggatgggcgtgggggtagagggccggtgagaaggaaactgtttagcgattcacctgaaactttaactatggggaggtggagagagttgcctatttcagaagatttccagggatagaactgagagggctttgctaagtatctggtatagatgcctgggtggatggtaacactttgacgggaagacactagaggaaattatagtggactggagaaaggagattagtttattttttgacctgttgggttggaggtgcctgggacttagggacttaaagaggagctttaagtgaataggtctcaaaagtaatttccagtccttttcctttacaatccacttcctttctcaactgccccaaacaagcattgtgagtttctcatgattccggaagtttttaagctaggttaaacaagaaaggagagttgaggttgaagtttgcaaaaatgactgagtctgggtttaaggctttttcactccattttgctaccaaacctgcaaacaagcagtgcaaaggaactatgccagctgagggcaccgggaagtggctgctcttccctgatgtcaccctagttccaagatctgagggtcagtgatgcccatgggagggaaaactcctcaggccaggataaagaaaccgtgtcttccagtctttacactagtttggagagggcccacatcagcatgcatggctctgcctactgtcagataagggaattccttgcatacgacagttaaaagccatagtgttctatttcctccttctttatgccccttcacctctctttcacttttgactaagtcttccacatcacaaagaaaatagaggtaccctccacttctaaattctgttaccttcattcatctccatcaatttcctgcttgtttcacagaaagccatccccattcattccctggtttgcaaaaatgaagtcacaaaaggcatgcaatacaacagattaatgatggaggaagacatgaagctgagagaatttctttaggatggggagcaattgaatatgtttaaatattaatgtaaaagagatagtaaagaccaagacattgaagttacagaagagaaaggattgttggtaagtctcataagaagctggaggcgatgggatccaattgcagatggtgggtaagcactgaggtggaggaaagaccactcttccatcatcatagaagaaaaggaggtgtattagtctgttctcacgctgctaataaagacatacctgagactgggtaatttataaaggaaagaggtttaattgactcacaggtcagcatggctgtggaggcctcagggaacttacaacaatggcgaaaggtgaagcaaacacatccctcacatggtggcagggagaagaagaatgacagccaagcagagggggaagccccttataaaaccattagctcttgtgagtacttactaccacaagaacaggatgagggaaaatgtccccatgattcaattatctccacctggtctctcccatgacacctggggattaccggaactacaattcaagatgcgatttgggtggggacacagaaaaaccatattaagaggcaagaatgcagaccgcaaagaagataacatctaatttgaatcccaaaggcttcaacggaatttaccatctgaggtagtcacaagcccacctgcggtgtggctcagcttggccccctattcatgtagcttcacaggtatcttgacttctgggagggtttgggagcagcttctgcagccttgggagaggccaaacacagatctgcctctggatccacccgcttctccacatgagctgcttttagtccagctaaccaccaaagagccaaactgctatccaccactgcctgtttggggacccaaatcccagatttgtatttctgtccaggaatgtgtttatcttggtttgaattctaggtctgtcttttaagctttcttttttcccctattaaaaaatcatttatgtgtgtggagcagaataaatgcctcatattgtattatctactagaaatcatccgcatttttttgaaataatgaacctgttacttcttctaaatgataccaggtgtccattttagttcaaatacttacaatgttacctcaccctaagaatcctcatctgtataatatttttcactttcagtgaaagtacagctgcacggagaaaatttctacacaattaagtttaaaaatgaaaattgctctattcttgatacaacaatcagagaggaaataaaacataaaatctctgccattaagatctcctgtacaggctgcctccaccttaggagcaggttgtgttttggaagttcacttgtaaattttgtgtttggaacatctaaaataatttccatagaaaaaatattataaattgtaattgtttccagaccagctcataaaagcaaatttgatacacaatatacttgaaataccataaatttgcatgaaataataggaaacagcaaatgtaattatgatctgtttttcttttacacacattaaaacactctttgaaccaatgcaaagcccaatgacttgactaatttaatgctggagtctgagccataggtggagttgggaactcattttgatctatttccattatgccagtaacatatgttgttgaaatttagagtgaatggaacaatgagagtgggaagatgctgactgtagtttgggagtttcgcaatagggaaagatggctaaatgggtcttgagccaagaaataaatttttattttcaccagcttttgactcaaagtatttaagatgctccctctctcaccaacaccaagagggtgacagagagaaaaagagagagagaaagagaaagaacagagggagagggagaaagagagagggagagaggaaaagggagaaggagaggttgggggggtggagagagagagaatgaatgagagctgtgggaacaagccaactatttaactacctagacatgcactcaaatggaagacaaaatggcagctataataggcagagaactcattacctgcagaaagcagagagagctcccacgtgaccacaaccactgtcagtggcaattaaattttcaagtagtgggaaaagaagtaaataacggtaactgtcctcaggtgaggccgggtggaaagctgctcccttcattaaaaagaagggagggagggtgactccttaagagtcaactgatggtgctgagggtgaggctcatgtgggaataatgtagcttctacatctaccagcaacagaaggcaggggacctgagactcctttcactgtggtgctggagaagcaaggattggggttatggcggtggtgattctccaccaggcagcctgagagctgccaggaagactgaactggagccatgcaaagaggccaaaagagacaaactgaagttactctttccagaagacaaaagggccataaagagaaacaccattttcacttaatggacagtagcaagttatatatgtacgagtcaaagcctgctctttcaatcctgaatatctgataagcagatttaccttgattagtgtttcaaaatactcattttaataagtctttcaacttattgtttgagtcattgaaacggatacagctatcacgcatttgaggtatatactctcctgttttaatttagtaaaattaaaggagatcataggcctcatatttaaatatatttaatttgtttatatcaaatgtaaatccttttgaggggaacaagaacatgtataaacaaatatactataaagcaggatactacattacttaatacgtgtttgaattttaactatcatttataaaggttaattcatcatacaaaattttggggggtacaaattggtgccaagatctatgttaggtggagtgaatataatagtgtataagaaagacacagttcttgccctcttggaagataaggcatagcagaaataatagaaaagccaaagcaaggacacaaaatattcaatatctgtatttcctggcctgccgcctactccttcgttcattgcaatctgacttccactctactccaataatacttctcttcctgagccattatatggtttttcatgggacttgaacatgccctaattcagcttaaattatctttagcagttctgtttgggtttaaaattcacatccttagaaacttcccctaaccacacagaatgggtgaattacaccttccatttgttcccatggaatgctccacgtcctctctcatgaattgtaattttaaaaagtcaattcattgtctgagtccttccctggcctgttagctccctgaagggtggcaccagttatattcactatcaaattcactcccctatcaagagtatggtcattaaaaggtgttgtgtagtatctgatgaataaatgaatgaatacatgaatggaagaggcattatataataatcagaaatattaagttctaaacagagagtgatgggagatgaaggtggaaatgtactcagctcatagagagtcttggatatctttttgttgattgggacactactgatcggaaaagtagactcaagagttatcattaatgcctcatttatgctgagctaggaaaaggaaaagacgattccagtggaacagactttttcacatgattcttactgccttgattgattcaatatttactatatacatgatgtctctggggaaaatgagcaagaggaatggaaaactctgcagatgaaagaggacgatggcctctcggagaatagaaatggcagggatggagtgaacataaagtttatctgcagcagtggcttccagatagagaacagctatataaaaaccaaaatttagaagattcctgattccaatcccagaagactgtattatgtctggatggagactaaagatctattacaactcttcagacaatactgatgtgtaaagagaacgtctcatctagtttaaccctttcgtttacatgtaaggaagctgaagcccaggagaggttcagtgacattgtgcaggtcggtgagctaggactaaaattcctgtctcctgaccttgaggtcagggttcacagcattagctctaaagaggcaaaataattacccataagtttgaagaataaaattcaaagagaacaatgtagctttatctacttatactacctttttgaagttaaaggtagaaactagttttctcaacctgagttctgaagctcgagaatgagatgggtccacactgcacaatgtagccacctggtttaccgcattaagatcacagcaaacctacagaactaacagatttccaggcctgtgatgacaatgaatctgcagatggctggggggttttatgttgagggttgagttactaatggcatgaatcacgagcagcttgtagagaatgataaacacctgttcttcataacgcctaagtacagaagaaaaatgatggaccaacatgatagtgttactgacttgggctgaatatgtatgaactcttttcattagtaaatgttagaaagggttatcaagggagattgtttaattaccatttttggtaggtccttagtttgaatctggaaggcattagacctaatctttccaaatgacagagagtgataccaattgatgttgtattagagcccagtgagacctctgcctttaaatgtttcctcagtggaatatcctagggactctccaataagacgagtacatatgagcacagatcctaatgaaagggtttgatggtgagtcatgattccctgcatttcacccagaaagatcagcaatcactcaattagcttccacagagaaacaatggtcagcattttccttagtctctcgagacaaggataaagcagtacacccctatgtaaaatgaatgaatcactacaggcaagtgacaggtgctattcttgtgatgtcaacaaaagtcactgtagtaatgaagattttctgaattagattttagcttcattcttcaccccttctcctttttttgaccattcttttgcagcttgtttgccaaattcaggagagaatgcaagcagcttttcatatgttcagcagtcccaagaaactttttaaaaatacaaacatgtctgtgttttgtatgcgtttttgaaaatgtatgcatttaccacacttcatacatacagtttctttttgcagaaacaggtattcccaatagaaatacatttttcctgcagttttagaatctacacaggtcaaattgtacattacttaactctgtgacaggaaggaaggcaggcaggttgttgcccaatgcatagcactgacaggcagggcaaaggacactgaactccaaatgtcatcaaactcaatgactttgagatgagtcctgctggactataggtactgccagagctatctagtccttaaaacataccatatatgtcgcttattcccaaactgacagattctgctagtaatctggaaatgcaggaaaaggaaataaggtgatttaatttttaaaagggcgcactggctcacacctgtaatctcagcaatttgggaggctgaggtgggtggatcacttgaggtcaagagtttgagagcagcctggccaacatggtgaaaccatgtctctactaaagttaaaaaaaaaaaaaaaatccaggtgtggtggtgcgtgcctgtaatcccagctacttgggaggctgaggcaggagactgcactgctgcactccagcctgggtgacagagggagactccatctcaaaaaaaaaaaaaaaaggataataatgatacctcatcataggtcctttatgaaaattaaatagcttaattggtatacttttcataatatccctcataatacaaatattctggttaattgggaatcaatatacgtcacatagattataaatttttacacagtataaaaatatcccatcacataaatcatatttattataatttaccaattttaatcattcaaaaaatgtttcaggaaggcctgataaattggtattattatatgaacaattaaatttgtcataaataagagattctgtcatctaaagatgtaccaacaatctacagataataaagtggcaaataaattatatttacatcatttcataaggtactttctcacatattaaagcataattatagtacttattactttcatttgtttgcttattaattgagcaaacaggttttggggattaagtacaaagcatgaaattagactttgaaggtataaagattaatgagatacagtctctgccgttccttgaagcagatgccaaagcaaattggggcaaaaacatgagagttggtaccaagggatttcatctttactctgagggcgaagagaaccattgaagggtttggaggagcaaagtgatatgatcagcttcacatggagattctcttgggaaatgatttgagggaaccagttggaggagcatggcagaaactgaggcaagaaatgatgccaagttgacccctgaagtaacatcgagtcaggaggaagaatggaaaggagtagatgcattggagtgacagcaagagtataaaacccactagcttgagagttaattaggagaagattatttccaaactttaactggggtctctgggcagatatggtgccactcagagatgtagaactctggaagaatagcaggtttaaccttgggacacaatgagatcaaacttggacattttatatcagaaatgtcaatgggaaattttagtagaaatggtacccattgaagatcaggggagatatttcagtggaggctatagagatatatgcattaacagtgtcaaatagctgcagaagacaatggggacctcccccatatctcaaggaaagttttctgagagtaataagacaaatacaagaacaagtcttgggcttccaagatttaagtagtgacaagcctgacaagaagaatggagaatactcagatgagtaggaggaaaattaacatagtaagtggtgttaaagtccaggagccagcggtaaagaaagaggacctggctgagggcagcaggtgattcagagtccatgtaggaagtcttcttgatttggcaccaaagagtctcctgagactgtggcccgagaaatttcagtggacaccagagtgccctagattgaggagtcatcgctacagaagataaggtggagacatgaggtgaggacaatgcttccaagatgccgaaactcatcaagacggataaaggtcaaaagaggactttggactttatttgtttgaagatagacatgtctaaaccttacaagaaagagacagaagagaagggagtatcaaagacaaaaagaaagtgagggaaactgaggaacaggaaggtggcaggaggagatgggaaccggagtcgtggattacagactgatcagggcatacagatacaggttaaggaaacagattttttttttttggtggggggaaaaggattcagtataaaaccctgcgtttaactctgattttattcatagggtggcccatttttcctattcattcagcaagactcagtgaaggtttctctcatcctggaattgtgctaggcacacagaggatacagtggtaaatcaaacaaggtccctgcccacaagaaacccaccctgttggagctggggtggaggcagagggtacacacgtaaatttctaatccaaggcaatctgtggaaatcttagcattgatttacagtttgcagtggaaagccctgtatatctttctatctctcagacatgaaaaccaatattaaaatagttcaccctccttaacataattgcaaacagcaatcttttaaatgttgaccactatatagatacattagttataaatgtagccaggggactagaattaattaaccttagcagtgaattccatttgaacttagtctaatcagggcaattttctattctggagaacaaaattaattatctggttcatttaggaagagaatcccaccaaaagaaaacaaacaccagaattttttccttaattattaggatattaatacaattcttgatccagtgtcttccctctgataagaaaatgtacaataaaaagaacgacattttaggccaataaatagataaggaaagagataaagagttcaggttaacttatcgggaaagctgagatttattttactgtagtatcaaatttgttctctttattctcactttattgtattttgctccagtttcccttttcataatatgcaagataattttgtattatcaatatcttatataccatagagccaagaaagtgataaggtaaaatattttgaaatgatgccatctgcataaattatttttattgcattaatttaaattaaaaattatctagatatacatcaactcagaggtatcaccacgaagtatcttaaaataaaattatgaatgacaaaatgctattttatgcagcacttatgttgctaccaattatctttgtcaatatttaaagacaggccttacacaaattccaagattttcatgagaaatagtgaagatattaacaaataactaaggggacgagcagagtctcattctttgaacggcgtatctcatatgatccaggtttctgtcagccttgatgctgtgttttcaccgaatagatctaacaaatgaaccttaaaagtaaatactcttggaaggacagtaaccattccctgatactgcagtcagtatttctggttctatgtggccagtaagagggaaatttttttcccctttcattaaaacagatgggttcatttgctgtccaaaagcgaatcagcattaatttggggcatccttactatgccaaggatattggcagatttttaaaactcaagtaatggcttggtgtgtttttaaaacaagcagaaatgcaattttcatagcaaaggtaaaacatcacatctctggcagtgcatctcctcctgatgttggtggtccatttctcctgccaaaagtgggagcaggaacacatttgggtaggaagatgcagactgaaaattcactgaaagaaggttaaggattatactagggacatagacaaaaagggaatacacctgaagcaattttagaacacaaaaatgtattgcatcctttaaattcactgtctcctaaatgtattagtccattctcacgctgctaataaagacatacccgagactgggtaatttataaaggaaagaggtttaattgactaacagttcagcatggctgggaggcctcaggaaacttacaatcatggcacaaggggaagcaaacacgtccttctcatggcagcaacaaggagaagtgcagagtgaagctggagaaaagccccttagaagaccatcagatcttgtgagatctcagtcactatcatgagaacagcatgagtgtaaccgctctcgtgattaaattaccccccccccaccaggtccctcccatgacacatggggattatgggaactacaattcaatgagacttggctggtgacagagccaaaccatatcacctaccaactaattttaaatgttacactctttaattttctacctgtttattttcattcatgttcatagtcaaattttttaaacaccattttgaatgtttagaaaaatcatggacatgccatacacgaccacatgtacagacacattcacatcactttgctaagcatgagtaaatatatcctagcttaatgcaacaatgattgaatcgtagagttaccttgtactatctttgtaggattccattattaagacaagcacagaaggcttagaatagacaacttctatcttactccctcatagttaggattaaagagattatgactgaacttttaaattggtagaccttatttttagagcagttttgggtttacagaaaaactgaatgaaaagtatggcaagttctcataaaacctaacatcactcagtttcctctattagtagcatcttgcatgagtggggtacatttattgcaattgatgagccaatattaatatattattattaaccgaagtccataatttacatgaggattcaccgtttgtgttgtacagttcaaggaattttgacaaacaataatgttatgtatccattgttacagtatcatattgaatagtttcactgccctaaatatctcctgtgttccatatatccgtccgtctctccctctttctgaactcctgggaaccactgatcttttttctgcctgtattttcacctataccagaatgtgatatacttgagaagatgcagtatacagccttttctggctgcctcctttcacttagccgtatgtatgtaagggtccctgcacatctttttgaggtttggctgctcatttctttttagcattgaataatacttcactctatttttgtaccacagtttgtttaaatgttcacctaggatatcttggttgtttctaaggtttgacaaatatgaataatgctgatataaatattcatgttcaggttacagtgtggaaattagtttttaactgaattggataaataccaaggaatatgattgctagtacatgtggttatattttgtaagtgacactgttttccaaagtggctgtaccatttcacatttccaccagcaatgaatgaaagttcctgtttctctgcatccttgccagcatttggtactgcagttctttaatgacagatgatgttccgtgtattttcatatgcttacttaccgtctacacacacagacacacacgcacataatatatatatatatgtttggtgctatgactcagattgtatattgtttttggtgagatgtctgttcagacctttttcccatttccttggttagttgttttcttattgttgagttttaagatttctttgtgtactttggatacaaatgctttaccaaacacatattctgcaaatattttctccctgtctgtggcttgtctttctattatctttattgtgtcttttggaaaacagtatggagatccctcaataaaaccacagatgtataaaaaggttttttctgaaagtagtttttaattttaataaaatccaagttatcaatttttttctttcatgaattgtacttttggtattatatctaaacacattgctaaaactaaagtcatgtacgtttttccctcttatgttatcttctagaagttttacagttatgcaatttacatgtctgtctacgatttatttttatttaatttctgtgaaaggtgtaagatctgttagaattttttttttttttttgcatgtggaccatttgttgaaaagtctgtcctttcttcactgaactgcctttgcttctttgtcaaggatcagttggcaacatttgcatgagtctatttctgggctctctattctgctgtattgatctatttttctgtcttttcaccaatactatgctgtgttaattattgtagctttgtagttgttcctttttaaaccttttaagttgacaaatagtaattgtatatgtttgtaggggtgatatattgtgatattttgatatatatttacaatgtagaatgattaaattgagctaattagaaaattcatcacctcatataacttatctttttttgtgatgaaaacatttaaacctaatcttttagcaattttgcaatatataatacattattattgattatggtcactattctgtgcaatagatcactaaagcttattcctccgatctaaattaaattttataccttttgaccaacatctccttttcctcattcatgtcccaccccagcttctgatagtcatcattctactctatacgtctatgaattcaactttttaagattccacatataagtaaaactcagtatttgtctttctgtgtctggcttatttcacttagcataatatcctccaggttaaggctatgtgtctgttgtgtgtatatacttaagtgataaagaaaatgtgtatacatacatacacacacacacacacacacacacacaattttctttatccattaacccactgattgacacttaggttgattcacatcctagctattgtgaataatgctgcaataggcatgatagtgcagatatctctttgatatatttatttcatttcttttagatatataccaagtggaattgctgggtcttatgctagttctatctttgttttttttttttttttttttttttaaggagtctccaaattgttttccataatggctataataatttaaattcccatcaacagttcctttttctccacacccttgtcaacatgttatcttttgtctttttgttaatagccattcttacaggtataagatgatatctcattggggttttaatttgcgtttctctaatgattaggataataaacattttttcatatatctgttggccatttgtatgtcttcttttgagaagtgtctatttaggtccattgcccattttttttggactgggttatttgttttcttgccattgagttgtttgagttccttaaatattttgaatattagccccttatcagatatatggttggcacatattttctcccagtccatgcaatgtttcttcacactactgtttcctttgctctgcagaagctctttagtttgatgtaatcctatttgtttattttttattttgttgcctgtgcttttggggtcatatctaaaaaatcactgcccagaccaatgttacggagatttccattatgtgttcttctagttgctttatagtttcatgtctttagtctatttaatctttaatccatttttaagttgatttttgtgtatggtattaactaagcatctaattataatcttctgtttgtggatattcagttgtctcaatattattcattgaagaggctgtcccttctctattgtgagtttttggtacctttgtcaaaaatgaattgactataaatggctgggtttatttctggtgtttctatcctgttttattgttcactgtgtctgtttttatgccaggactatgctgttttgattaatacatctttgtaatagattctgaagtcaggtagtgtgattcctccagctttgttctttttgctcaagattgttttggctattctaggtcttttgtggttccatataaattttaggactgttttttctgtttctatgaaagatgacattggaattttgatagggattgcactgaatctgtacatcacattgggtagtgtgggcattttaacactaattcttctaatctgtgaacacagaatacctttccatttatttgtgttctctacagttttttcatcaatgctctatagttttcagtgtatttcacctccttgggtaaatttacccctaagtattttgtatgctgttttgaatgggatcgatttctttacatctgtgaacaaagacagtacataaaatctaaatctctctttccttctttttccagtttagattctatggctcataatttcattaagactcttgccaagaacttagtatcctttgttctcatttcttcacttccatctggcaaaatcccaactgtgcatgagtgcaactcaactgggttattttgcctccatttgtgcaagcacaggtggggaaatcagaagagggtggatggcgacactgtaaatttgtcatcaacaacatcaaatggccctcaggacggataagcaatttgactatatttttattttccactctctctagtttctcccatagtgattttttcaaaacgtttccatttgcctcaagcttggacaaattccttaatgttctccattgacatggtaaatttcttatgatctacttcacacaagaagaagccatcatatatatggaaattccatctagtattccctaacaaacctacaaatctatctagatgaactcttactctttttaaaaatgtttatttgatgagcagggaagaaattctttctatctaggtccagggcctcttcttacacagcaatgcaatatataatgatattttaggtcaacagtggaccacatatgtgacagtggtcttataagattataatatcatattttcactgtgctttttctatgtttagatatgtttagatacacaaatatttaccactatgttataattacctacagtattcagtacagtcatatgctatacaggtttgtagcctatgagcaataggctatatcatgtagtacatagtagtctctaccatctaggtttttgttgatgtttgcacaacaatgaacttgcttggcaatacatttctcagaacgtattctggttactgtgcaatgcaagactgtaacttgaatcctatgttttcgggaacctcaaaatagcaaccatccgctcttattcccacatattcaataattttcttacaattgaatcccttgcctgttataattaaacattatcaattatctccattaaaaaaattctctcaacttatatggcttcttgtttcccattttcctcatttacaataaaaataatcaaaagagctctctgtacatatgacagattatatatttaattaaaatattccctctctattgctgcctcactgacatcaggtttggttatgtgactttctctcatcaataaaatatatatgaaagttatgtgtgctgcttccaagaagcagcttttagagtaattgcatgcacctactcctttctctttttcttccatcataagaccaacgatgcctcagaataacacctgctgcttcaccctggtcctggaagatgcaggacatcagcagacgtgaagttgactgacagtacacggtagtttgagcacaaaatcaacccttgcaatagtgtgcctgctgaaattttaaaggtattttttactgcctcatactttactctatgttgacttgtacatgactttttgcctccattttctccctccccattactactcaacctgcttaaaatctgacttcagggttatctcttcgcatttacatgtcaataagttaaatggcgatttttcagtgtgactttagctgatctctctaagcagcatttcaaatagttgatcactaccttctttttgaaacagtcttttcagaagaatctcttgcatctttgaacacgaatattcctgattttttcccaaaaccttgttgttgcccctcagtccttctcattccccatttccttgagtattaaatatattagtttctcaattttctctcctaaaacatcatctcttttcattctatattctcttcttagacagcttcatcagatgattttattttctttctttacttaaataatgttcaaacatatgctttcagtccaaacttctctgaatttctgacacatatatccaattgcctactttatgtctctgcttacatgccttaaagtgatattcaatatgccccaaacataatgcttaaccatttgccctaaaccatgcttgtttctggtgtttattttgttttctctcatttccttctctcataaactccatgaggcagagcccgtgcccatttttgaatcttggagtacctgatatacaaggcaccaaaattcccagcatgataaatcaaacaattaacaattctgtacatcagggtaaaactgcagataaagatatgctcatttgcagtttgcttttcaggtgattcactatagttagacaactaattcttcagcaacaacaatggaagtcaggagttagtggagtaatataaaaactaaaagaaaatactatcaacttagaatagtatattgagtaaaaatatcttccaagaacaaggcagaattaaggactttttaatataaattaaaaaaaatgaagagtttgttttgccagtggtgtttccctatagggaattccaaaagatatgttttagacagaaaaaaaaaaatgatacaagatggaaggctgagatgcaagaataatgatagacaagaaagtggcaaaaatgtgggtaaactgatacaggcactcactgaataaaaccataataatgtctaatttgggggagttaaaatgtagaaagaaaataagaggacatagttaaaatattggaatgaccataaacagaaaagaaataaaagaaatgataaacacatattaaagatttttgctgggtatggtggtacaaatatgtagtctcagctactctggaggctgaggtacgagaagcacttatgtccaggagattaagaccatcgtactagcaacatagcaagacccctgtctctctaagaaaataaaataaaataaaatactgttattattttctttttaaacggtgtgtgaagcatttagtacatttttatactttataccctacagatgttttataaatattgctgacctttaaattaatatttaataaacatataaaaatacattttcttatctccagctgagtttgaaacatgtttatgcaggaataaaatgtataatttattagagagtgagactggcctagttcactgtttcttatattttccaaatggaagaagtattccaagaacagatccatgtttgaaaccttgtatttcagtgtgttagtctacaattatgtaccaaaatagttgcagccttttatatagcactttgaggtatcagtgggtactcacaacatttgaataagatgtgcaaagatcacagtatcatcgcatttgtttacaggaaataatctagtttacatagttagaaaagtgtggttagtgaggtcatgcagaatttcatcatttattttaataaatctcaagattatgtaacaacaatagatattaaaatggtcaccagatatgtaaaggcattactataattctgaatgctactctaaatgtttatatttccttgtcagaaatgcaaaattttcttgaaagtgtattagtggtgtcagactcacttttttcagaatccactactataacataaaatatcacccttcccagtctatacagagaacagagaagtagtccaaagagcatccttatggcacatatcattgccataggaaggtgaatgtctacattaaagagctaaatcattataacttaattcttagctgtaacctcatgacatttttatataaccagtcagataatagcttcaatcatttagatacaacttggaaaattctagttagagaaatgagaatgagcatagaacactgagcagagtcctgagacactcattccaggccctaactcctggttgacatttctagacaaaacctgggccagaagggaacctgttgccttgagtggaagaactcagtcctggcaggattcatcacgggctgactaaagagcttttggcctctgaataatcagcagcagtagccaggtagcacacactgtgggcaaccacactctctgggcattgggtgagactctgagatgtgctgacttcaggtgtgaccaactgtttcacagctgtcatggctatgaggagagaccccttcttcttgagaaaagcagaaacaagagtaaagaaaacagactaggtatcagtttggccataaggaggtagagtaccaagggggatcttggggtccgtgataccaggctaagctcttggacagcatttctagacctgccctgggccatatgggaacccacatccctgaagggtgagtttcaggcctgaccacatttgccataagctgactgaagagcccttgggccttgagtgaacactggcagtagcctggcaatacaacctgcaggcctgtggtggtggcagacacggaggaagacgcctctgcttgtggaaaggggagagaagagtgggaagaactgtcttgtgtttgggtgccagctcagccacagtggaatagagcaccaggtaggttccaaaggtatctgtctccaggtcttggctctgggcccatatctctggacccacctggggccagggggactcactacactgaagagaaggatacaagcctggctggtgttgccacctgcagattgtagagccctaaggccttgagaaaacataggaggtagcaagaaagtatttacagtaggcttttgggggacccagtgctgtgctggcttcaggtcttagtgcattcacagtggtgatgcccacaggaaggcttatgtcactgctcccccagcttcaggtacacacactcacacccccccacacacacatgcatgcacacacagatactctgtttctttgggagaaagtaagggaataaaacaagaggctctgcctggtaatccagaaaattcttttgtatctcatgcaatactaccaagaaccatgaaggtagcatttaaaccagctctagccagaggggaatcatccatttcagcggtcagatcttcaagcctctatgaggctggaagagtcacagcattacaaggatgggggtgccacttaatgcagttatggttgcagtgacctaaaacttagatcacaatacccacatcccatagatacctggaaaatcctcccaagacggacaggtacaaacaagcccagactgtgaaaactaccataaatacctaactcttctatgcccagacactgatgaacatctacaagcatcaagacgatccaggaaaacatgacctcaccaaatgaactaaatatggcaccagggaccaatcctggaaagacagagatataggacctttcagatagagaatttaaaatagcttttttgaggaaactcaatgaaattcaaggaaacgcagagaaggaattcaagatcctatcagataaatttaacaaaaatacttaaattattaaaagaaatcaagcagaaaaaagttgaaaatgcaaatgacatactgaagaatgtatcagtctcttaccagtagagctgatcaagcagaagaaagaattagtgagcttgaaaacagagtatttgtatatacacagaggagataaaagcaaaattaataaaaaagaatgaagcatacctacaagttctaaaaaatagcccccaaagggtaaatataagagttattggccttaaaaaggacagagagagagagatagaggtagaaggttcaaagggataataacacagaacttccccaacctaaagaaaggtagcaatattcaagtacaaaagggttatagaacatcaagcagattaacctaaagactacaaaatatttaataataaaactcccaaatgtcaagattaaagaaagagtcctaaaagcagcaagagaaaggaaccaaataacatacaatgaaactccgatgcacctggcagcagacttttcagtggaaaccttataggccaggagagagtggccttatatatatactgtgctgaaggagaaaaaaaccattgatcttagaataggatatccagcaaaaatattctttgaacatgaaggagaaataaagacatttcaagaccaacagaaaagctgaaatatttcatcaacaccagacctgtcctataagaaaagctaaagagagttcttcagtctaaaagaaaaggactttaatgaccaatatctgaaggtataaaaatcaatggtaacggtaaatgcacaggaaaacaaaatataataacattgtaactgtggtgggtaaacttttcatatcttgagtagaaagattaaaagataatctgattaaaaataataactacaaaaacttttcaaggcataggtggtataataagatataaatagaaataacaaaaagttaaaaagtgtggggacaaagttaaagtatagagtttttattagttttctctttgcttgttaatttgtttatataatcagtgttaagacattatctgtttaaactagtgtattataagatattatttgcaagactcatggtaaactcaaaaaaaaaaaaaaacagtgtatacacaaaaaaatagaaagcaataaatgaaaacagaccacaagagaaaatgaccttcactaaaaggaagccaggaaggaagaaaagaaggaaaagaagaccacaaaacaaccagaaaacaagtaacaaaatcacaagaataagtccttacttgtcagtaataccattgaatgtaaatggactaaactctcccatcaaaagacatagagtgactgaatagataaaattttttaaaaaaagacttgttgcctacaagaagggcacttcacctataaagaaatatatacactgaaaataaaagggatggaaaaagataatccatgcaaatggaaaccaaaaaagagcacggtagctatacttacatcataatagatttcagaacaaaaactataaaaaagagaaaaataaggtcattatataatgataacggggtcaattcaataagaggatataacaattgtaaatatatatgcacccaacattagaacaccctgatatttaaagcaaatgttagacttaaagagagaggtagacccctatacattaatagaagaagactttagcaccccactttcagccttggacagatgacccagacagaaaaatcaacaaaacattggacttaatctgcacctagaccaaatggacctaatagatatttacagaacatttcatccaacggctgcagaatacacattcttctccacagcacatgaatcattctctaaaacaaaccatatgtttggccagaaaactagtcttaagacattaaaaaaattgaaatatatcgaacatcttctcagaccacaatgtaataaaactagaaatcaataatgagaaatttttaaaactatgcaaacacatggaaattaaataatatgcccccaaatgattagtaagtgggtgaaaaaattaagagtgcaattaaaaaatttcttgaaacaaatgataatggaaacacaatatacaaaacctatgggatacagcaaaagcagtactaagaggacattttgtaactataagcgcctccaccaaaaatgtagaaaaacttcaaataaaaaaaaaaactaatggtgcatcttaaagaatcagacaagcaagagcaaaccaaacccaaaattattaaagaaaaagtaataataaaggttagagcaaaaattaatgaaaatgaaatgaagaaaacaatacaaaagatgactaaaatgaaaagtttgtttttaaaaagataaacaaaattgagaaaactcttgccagactaacaaaatacagagagagaagacccaaataaataaaattagaaatggaaaaggagactttcaacccaataccactgaaattcaaatgatcattagaggctactatgagtaactgtcaggcaataaattagaaaaactagaagaaatgaaaaaaaaaatgcctagtgagatgaagcctaccaagattgagccacgaaaaaatccaaaacctgaatggacaaataagaagtaaccagatcaaagctaccataaacagtatcctagcaaagataagcctgggacctgatggcttcactgctgaatgttaccaaacatttaaacatcctactcaaactgttctaaaaaacagaggaggagggaatacttccaacctcattctatgagatcagtattgtcctgataccaaaacaagacgaagacacatcaagaaaaagaaaactacaggccaatatccctgatgaacatggatcagaaatcctcaacaaaatactagcaaactgaatccaacaacacattaaaaacatcatccatcacggccaagtgagatttatcccaggaatacagagatggttcaacatatgcaaatccatcaacacatcatatcaacagaatgaaggataacaaccatgtgatcatttcaactgatgctgaaaaatcatttgataaaacttaacattgtttcatgataaaaaccctaaaaaaactgggtatagaaggaaaacaccagataaaagtcaataaaagtcaatatatgcagatccacagctaatgtcatatggaatggagaaaaactgaaagcctagcctctaagatctggtaagcaacaagcatgtacactttcagcacttttattcaacataatactggaattcctagctagggcagtcaacaaaaaaaattttaaaaaaagggcatccaaactggaaaagaagatgtcaaattatccttgtttgcaaattatgtaatcttatatttggaaaaacctaaggactccacaaaaattatttgataaacaaattcaataaagttgaaggatacaaaatcaacataaagcatcagtagcatttatatatgccaacagcaatcaacctgaaatagaaatcaagaaaataattccactgataattgctacacataaaattaaatacctagaaattaacttaaccaaagaagcgaaagatctataatgaaaactatgaaacattgatgaaagaaattagaggacacaaaaatggaaagacattctatgtttatagattggaagaataaatactcaaaatgtccatactacttacaacaatctacagatggaatacaatctctatcaaaatactcatgaaattcttcacagaaatagagaaacaatcttaaaatttatatggaaccaaaaaagacccagaatagccaaagctatcctgagcaaaaggaacaaaactggaagactagcattatctgacttcaaattatactgcagagctatagtaaccaaaacagcatgacactggcataaaaacagacacatagaccaatggaacaaaatagaggacctagaaacaaattcatacatcgacagtgaactcattatcaacaaagattccaggaacatattggagaaatgacagtctcttcaataaatggtgctaggagaactggacatccatatgaaggagaatgagtctagacccttgtctcttgccatattaagaaaagcaaaatggactaaatacttaaatctaagtcatcatattatgaaactactacaagaaaacatggggaagctcaatttgagttaatataccaaaagcacaggcaaccaaagccaaagtggacagatgggattacatcaatttaaaagttcctgcacagcaaagggaacaatcaacaaagtgaagacataaacccacagaaaatgtttgcaaactgcccatctgagaagagattaatgaccagaatatataaggagctcaaacaactccataggaagaaagtctaataatgcaactaaaaatgggcaaaatatctgaatagacatttctcaaaagaagacatacaaataacaaacgtatatgaaaaggtggtcaccatcattgatcatctatgaaatgcaaattaaaactacaatgctatagcaccccagttaaaatggcttttatctaaaagacagacaataacaaatgcagatgaggatgtggagaaaagggaaccctcatacactgttggtagcaatgtaaattagtacaaccacaatggaaaacagtttgccagtttctccaaatctaaaaatagagctattatatgacccagcaatctcactgctagatatattatgcaaagaaagtgaattcgtattatcgaagagatatctgcactctgcactcccgtgtttactgcagcactgttcacaatagacaaattttggaaacaacctcagtgtccatcaacagatgaatgaagaaaatgtggtatataaatacaatggagtactgttagccataaaaaatgagatcttgtcatttgcaacaacatagatggaactggaggtcattatgttaagtaaaatatcctggcacaaaaagacaaacttcacatgttctcacttatttgtaggagctaaaattaaaacacttgagctcatggagatagaaaatagaatgatggttgtcagatgctgggaagtggaaggtggggaggaaatggggatggttaatgggtacataaatagaaagaatgactaagatctagtatgtgaccgcaaaacagggtgactacagtcaataataattgtacattttaagataacttaaaaagtatgattggatggtttgtaacacaaaggataaatgcttgaggtgatggataccccacttaccctgatgtgattattactcattgcatgcctctatcaaaatatgtcatgtatgccataaatagatacacctactacatactccaaaattaaaaataaataatttgaaataaaacaaacaaacaaaaaacctaaaaagcagcgctgtggtagctgtccgtggtacttgtccacagtcctgaataggaatccactttggtttgtttcaatacttgctcaaatttatacaaattaatttcaagattacctaccaggtagtttttttccttcttatttattgtcagaaatattatctcttgagaagaaataaatgtcatattcaggaatattataattattcaacttatataaatatttacatgaaatctcaaacacgcataaatttttccttatatttaagcatatttaaaatatgacctggaaagacaaaatgcttgctgccaataaagcattttcttatggtgtttgctctccattagccccctttccaaaatcaattttcatacttctctgccctgctctggaagcctgggtggctgatctctaggacagcctgccaagctagctgggttttgattggattttgcctgtgggaagtaatggcagtaaagcaagagattatcagataggctgagagagaaactggggtatttcctccctgcaccttcactgctttggcaaaattactgtgaagcaattagatttttaaagactaccactcccactgtgtgatctctctgttagagctctagccctccctggggcttgcttcttcctttgttttcagttctattttttttttaataactcattcctaccatttctattctctggatcctcccatatcctctatttctttccttagtaaacaaattctttattttaaaaactttcttcatttaaatcatctgagtaaatcctctttccttccaggacaatgaatgattcagaaggtgtttaaatcaaagctaatgtatctaattgagaggaaagaatattcatagagaagaaatgaacattaaatgtctacaagatgcacacattagtagggaatatgctattgacactaagaatgaaattctgtggctattggtcgatgtgcaatccctaataggttaagcccattgtgtattaataataagtattaatacatagttgttcagttcatgtagaactgaataaattgaataataactatttcataattatttggagtttactaagaggtgagcttgaagtttaaaggtaaggtattattaaatcacggattcattttgtcacatttacacctattaattttacaaagagaaaacaatgagcataaaacctacaaactatcccaagaattcccgccatccaacaaagaaacagatgttggtggtcagaaaatgtaatgttcattatagcaaaaaattatgtgatctcttattctattgaggggtccttaaatttttttttaaaatcacatttgacagaagcttaacttgaatttaaatgtggctaaaggtattcttctttacataggagagaaattagtcagaagtcagtgcacactggagagaaattgtgagaaattataaatggttagacttgttttctcgataatgaactttttgcaactaaacagcaccttgaaatagtctaatggctgatgtaatgaatgtgtcattttatgaatgaaggtcttaaaattataaaagtgcaagagaatttataagacaatgttgttgtaatgtaaaagccatttttttgcagaaagaagtgcaagagcctaaaatttactatcaactttaaaatcagacattaagaacaaggaaacaaagctccagcataacaaatgtaagaaattttacactatctggtttgtggacctctggaatgtaactcaatccatggtcaaggaaaaatgcactagctcctctcatatgggacttagggcagcagaagggacctcaccgcatgaaagctagctttccctggagcaagcaactcaagagaccaaggtgaaaccgccagcaccttttgtgacctagccttagaaaccacagaccctcacttctgcagaaatcttgtacacaggtcagctctcaaaggaaaccacacaagtgtgggaacacagaagtcaagattatagggaccaccttgaagcttagctactgagtaatgaggagaatcatgactgctcatgaatttgttagttttaaaatgttttattttaaaattattttagatttataaaaggttgaaaaattggcacagtctcccatacctttcatccatcttcccctcatgttaacattctacatgatcaaatcacaatgatcaaaaactaggaaatgctggtacggagttatgacctaaactatagattttacttatttccccagtattcccacttatgttctatccctggccccgatctaagccagaaaacagattgaagtttgttattgtgtctccttagtctcttctaatctgtggcaattccttagtatttccttgtctttcatgaccttaaaaattgtacattttaaagcttactggtcagatgttttgcataaggtctttcagtttgagattgtctgatatttttctcactaataggctggagttatggatttagggggagattacctcagaggtgaggtgccttctcatcacataatatcacagggtacattatatcaacatgatttatcactgttattgttaacctcggcctggttacgatgttgtatgctggctctctctactgtaaagttactgtttctccttttccatgctttatttgttagaaggaagtcattaagtttggccaacactcaaagggaagggaattaagcttcacctcctggagggagtattatcaaggaatatgcgcatatgttaaaaccccctcagagatcaattagtttttaattggagataaaagatactttttgatggagatagaaagctgtataggaaacagataacatcacaggggatctgagaaagtatttcaactttattttgattattcacagtccattaccatttctttattcctatacttattttaatacaaataaacataatacaaatgtattctattttcctcctgtcatgctatactacatcatacgtttttaaaatattttgagaagcatgatttcaatatttaaatatcttaattttcacttctgactcagtttgagcaaaattccagtcatctataaaaaatgacaccaaagaactgtcctccaaacacaagccatgtaaagtttcttttttgctattttttttttttttttagtttcttggatggaaggtcaaatagacattaactataatggtccctaatgattactaataatggtaccaagaacatcttgacaaagtactggagaggttcccagatagcatatttttaagacagaaaattatgttagttgcactaaaactcaattttaattagccatgacacttacatacactttaaagctgatgaagtgctcttcagactaacaagtcttaataagctctgtttaaatttaatttctatttccatttgacagtaaccaagcaaaacttgtgattcactatgatgataacacagcagggttcaagtgctgtacattttcaatatgttcttagttatgcacccagccaatttaatttcaaatgtataaactcttctacccttccttctgagaacaataatttactttgaaagatttctttggatttttaacttttatagaaagaatatattaaatggaaaatattttatataatacaggccttttgttcttcaaattataaaaacaataacacttctttgaatcatattttagcaaatatataccactagaagaatgacaggtgaacaaatttagtgccactcagataactgtagtaattatatactatgtcaactctctacaagtctcagcatcaactctcactacacccatttcaactcacggcaatttggatagatgctgacgttctttttttcctgttttacttattcacgaaaacaaatctaaaagaatagtttaaaagaagtaaaagaaaggcatgtcataaaaaaaggatgtgcacgtgaaccctgaactttgtgtttaaatcttccttccttcctcccctcccttgttctccccttctctttcttgatatgggaagaaaaagaaaatttcagagatgactttacttcatttgtgaagcttcctgacttctgcccagtcagggttgttcccttttctgagcttacccacaatatttttgtctctcttcgaacaccctactcaaacctgttttccagcttattggaagcacatattcttctgtcccttggtgaagcactccttcaaattagaagaatgacacattcattttgtaccctcacgggcccaccacatagtggacacccattaaccacttattaagttgaattttagaaaaattgtttgattttaaaaattcaaaaagtgcatatattcaatggagaaaactggggaagcactgagcttgctgcactccctcccctcaaatgtgaggggtaactgggggccagaggagacatcgtgagagtaacatcatatgaaccacttgggaattgctcatgttggcctgtaaaatagcagttactctgcaaatcaagctataatccatgaaattatctaagctttgtttgaacctgctgtttttttaattcctagcaccatttggaataatgtgttacataaaaatttctttgttcatttgtttttgccagcactgcttaaatgaacactttctcttatttgattgaaaatacaacccattttcagtgttttgagaaataaaagataaacccaagttatgtctgtcaacatggtttacagttttataaatttcaatttcaatgtcttttttttttttttttttttttttgagacggagtctcactctgttgcccatgctggagtgcagtggcatgatcttggctcactgcaacctccgcctcccgggttcaagcaattctcctgcctcagcctccctagtagctgggattgcaggcatgcgccaccatgcctggctaatttttgtatttttagtagagacggggtttggccaagttggccaggctggtctctaatgcctgacctcaggtgatccgcctgccttagccttccaaagtgctgggattacaggcatgagccaccatgcctggcctcaatgttttttctctatcttcatgtagcaggaactttaggaccagattgcctgggttcaaatcttgcctcagccacttagttttctgacttgggcaagccatttaaagcctctgatccttgttaactttatctgtaaaatgaggataaaataatattacctgcctcataggattttgtgaggtttcaatcagtaagtacatgaaaatgaactcccacatggattacatacagtaaggactaaagcagtgttggacataattgtaatgattatcagtagaagtgccataattcctttagtcatttaacattcctttcgctgggtcttcatcaagtccattatgtctcttggaaggatagtgtgcaaactgcacctagtaaatgtgccactgaagcacggtgtggtagaaggagattgcaatcattttccttgtgcttttacacctcttcctcacaacgcttaggaatttgttcacttatgtgccactgccttatactgaaccaatatcttcaaacatcagtcaaaagtgacaccctaatttacaagctgcactttatagcttagactctttaagttttataaatatttttttccctcccttaaatgagttatcttaatgctttaatgcaatgttgtttattccccatgttgagctactttcactgatatttatcttaagcgaggtggcttctactagataaaataaaataataactgcgcaattgtcttttctagctgatttacaaacatgtaaggccatgtctctaccagtcgccagaatattgaataaccaattgtttgcatataggtcttctattcttattccttcattttaatttagcaaacatttattgagcagttaaagagatgtgcttcgtggcacaatttagcatgggaaaaacatataaacagttctcctacccttgaaaactaaataaatgagtcacgtctcccctgctccttctggttcaggcatattcaccctgacatagaacattaggggtttagtcaagactgtgctttctccactcttctcagagttcactgtctgaagctatcgagtagctcagtgttaggacagagggaagtcgggaaatgactgtgtgtgcctttctgttactaatcctgaactcgccaattaattaccacgctatctgaagcttcggtccttgcctatttgtgatctgaaggacaggatacacctgtagatcctgcactggaaactctaaatttatacttgttgttgtttgctagtaatattcattccctttctcagcagtatacctagttctttttggggaatttcccttcctccagtgggcgcagtcttggtatgatgataagtcctagaagctaacggagaccctgaagcctccttttgttaggattttcaactgagtggagaaatgaaagacagaaaaaacggtcagggttaatgccttgattctggggaaggacgggggttgagtggttcagccacactgttcctgccacccacagctctggaaagtccaggttcctgccttttctgagactgactctgcggccctctcttcaaatttgttagtttcctcaagatccttctaatacattcttgcttgcttatgttatccagagttagtttcttttttcagcaagaggccctaaaagactccatttataaagaaaaaaaaaaaggaagcaatttttgcctgagttatgagtagattaaattcaatatgtacaaatggctccagtgacagcgggaattattgaacttaaactaagttatgttaacatgaatcactttgtaattatttcatatcactgatcatgactactgccaaatgagttatgagttgtaaagctataataaaaatattatgatgcaatattatcatacatgccaagtgaaacattccgttaaatctcttacctgaagaaaaatctgtagatgccatatgccatttaaagtatttcaggtatagcatcctggttgagcatcccaaattcaaaaatctgaaatccataatgctccagtaagcatttcttttaagcatcctgttggtgcccaaaatgttttggattttggagcattttagatgtcagatttttggatttgggatgctcaatttgtatttctatttgtacaaggtaggcttcctctctgtttcatcaattataaaagataatgctattttcttcaaaatattgtgagttaaatgagatggtatctgtaaacgttcttagaagaacttctgtgaattatgaccccaatctaaatagacattccaaactattttctactgaaaacccaaggtcaggtttatatccctgatacatagaataaaaaagcctgatatctgaagttacttagatcatcagaaagcataaagctagctttttaatttaagtcaatttgacaacttcttgacaacattttgatgaattgtgttctcctttaattaaatagaagcagaaaagacgtctcagtgttgaaattttttaactatgtaaatacaccgtagaagttttgagaaataatacctctttttcactctcgatttttggtatccttccttcaaaaaacttactcagtaactacttgctgagaagttttattcagtaaatatgaacatgatgatacaagataatgagggattatatatgtatagcagcactattaattctaatcaaaatatgtaactaccctttcaggttactgaaagcaaatgagctggcaataggagctgctttcatattattagaaatgggtgccctttaggcaaagatctctccaagagtaatctgtggaccacctgcatccaaattacttggaattacttttcaataaggtgaatttgaaaaatgcccctctccaccccaaattattgaattataatgtctgaagaagtagaatacaggaaaaatcatcaataaaaacttttcacataatttgcatgaacatcaaaatttgagaactataactcagatcatctgtggtagactttatcactgagtaggcaatagtcaaagtgggccactatgtgatgctgggagtgttgtgcagtgcacaacttcagagagtgctgttggtatcacagtctataccgtacagcagctctgattgcaagatttaattcatatcttatggttgccaaggagaagttaccaaaatagcaactgagagaatctatcacatttgcacttttcaaatcttcagctttacaatgtcatcaagcatgagatgtgtgaaggactgtgttttgatctatctcctaaatcctaaagggataattgacatcatttaaaaaaaattagtttttttcatcatttatttgatgaattctaggttttttaaacaaaggaactgaagaaagaagaaaatcttttgtttagaagttttgggtcattaaagtattgaataagcaattttacctgctgagaatgatcagcttttagtctgcagttttttagttatgtactcagaaggtccctaaataaaaagaaaactataaaaattgatttcttctttttttcgtatggaagtggtaccaaatactgctttaaaaaatagtctcacattataaaaattagcccacattcatgtgatattcagggtaagtggctctggagccacaactaaattgtagcatctcaacacccgtttcctcaaatgagatgctaaacaaagtgtcttcgatttaaaatcaaactatacaggcctccttagttgcctgtgtgttgatggatattttcagaaacagaatctaaaataatatttatttggaaggtttacaaagagagattactacttttctcagtgcagattgtccaagttggtccaacttcaagagtatttttcaatctggatatgagtctgcaaatccacattgaatccattaggacctacttaatataatttcctccccatatcttttatcctccttttccatgccctgtttgtttatttaaacctcttttttcatcttcttagtctttcaagcatgtcaagttagtcctccaaagagacatttcctttgtcttgtaatttacttgttgtgttaggaattgtcaattaaccaaatagtcctttactgaaatgcaaactggttttcagattcaaatagttgtttttaataggccaggaaatcccagtgaataattactgtttacatagtttccacagtgtttatatgcattttttaaatttaaaaaaatgtgaagaattttcttacttgtagttttccttatagccttgataatgcatcttattacatctatatttatgcattaaaatctagtaggtataatttatcagtaagaatgaccactataatgccttaactttatttaccaaatacactgctagaggaaaatacaatcaaaataaagatattagaaagaaaatgagaaaaaagaagatgacatagattcctaagaaagtaagtcttttaataggtttctggaacatcaatatcagactaattataatctcttgaaatcagattttctggtgaaagtagaacttatgtaagaccagaatgaaaatgtcaaaaaagagattaaactctgcatcagttttcttttcctatacatagataactatgaaaatgaaacaaatagaataaaaatcataagtgtcctaacataattcacataatcagagccttttggataattccagttatgatccatagaaataatttcttcttttctgatgtgaactgagttgtgagagcactgaaatttggaaagtattttgttacaaattggcaaaagtttcaaatctcttccaatgcatgctgttgaaaagatcaacaaatgatgggcttctcaaaagttccatgtggttactatgcaatcatacgaacttacacaatttcattttggctaaatgatgatggaaaacaaatatagcacaagatgtgcccgctctttcatgtcagcattcataggcctatcattcactgttactttactccccagtttaatcgacgtactgagaactaaaggagaaaaatgttatctttttcatttcttttttggttaacttgagcaattcatttttggtttattaaaagccaaaacaataagttacccagggcttgagtcacatcttttatcactgcacaaaacttgcctgtgactggttatgtctgttagaatttatgtggatgagacacggcaatgtgtgattgaacaagtcctcctggggattccaatgccctgtggttcttaaaacactgattgctgaggtcactcctagagttcttgattcggtaagtctggagttaggcccctcagttcgcatttctgacaagttcccaggtgatgctgatgctattatctgagaaacacacttcgcttacagcattgataaatgaaccagtctgtgaattttcatagactgcctttcatttcctgtcagttatgataatgaaatctcactgtaagtccataaagtaacatcaaagctgtgtcagctatgaacacaactcttagaaaaaaaatggtcgcatatgaaatgcaaacatacgatagaaattacagagcacttattacaaagagataaatcttagttacatggatgaaggaggaaaaggaaataatataccatcattctgaaacaaatagaaatgcaaaatccaacagcactggctggaggatatgggatgccaccaataaaaagtattttaagtatttcttttacttttctaaaaattgtttttgtggactgccattagattcctacacattggtgttgtcctgaatattttggaaagaaacttaggcaatacttccattgactattgacaggccaatgatactgttctaagatttttttccttatcattagttttctaaacatttttaaatttatttttaattgataataaaaattgtatatatttatcatgtaccacatgttgttttgaaatatacatacattgtggaaagggtaaatcaagctatcccttatagtcatttatctgggatggtcatctgccattatatagaaaaatgatacattattttgcttccatcatgaaaaccatcaggcgccagacatatctgcttctcaaaagcagttccccttcatcctcaaagccctcgacctagtaatgtatgattctgattttttgtagaatgtgtcttttcattacaataaaatacactccatttctttgttttgggaagattatagctttctccccaggctttttaggggacaaagactattctccatatgacgaacctatcaagattcatcttgaaatattttatgcattctttttttaatccactggaattaattttgttcttggatcaccttttcaaggacacaatcagctctcgcagctgactgctccagtgggtgctagaaagtccgcccagaattctggcacatggatctgaaatgaaggagaacacaagcagccaggcattaaggaggatttggggtaaatctgctcttggaaatgcaaacttaggaaaaactttccacttcaaaaaaagagtcagaactttctttgggaagtggcagaacaaagggaccttgcatgctcattcaaaaattcttttcagaaacatttgcacacctgggaggaagaaagcgggaagggcaggcagtggcactaggaacccgatacctggtgggcctgtgatcgcatgggtaatacccacctgagggctagatcacacatgtagcatacctgtgagggctagatcatgcatgtaatacccatgatgagggctagattacaaatgcagtacacataaaggtgagatcatgcatgtagtacccatgtgagggctagatcacacacatagtaactcacaatgagggcaattacacatgtaatacccatgatgagggctaggtcacacatgtagtacccacgatgagggctaggtcacccaaagagtactcactatgagggctagagatgcactgacacaaagtggccatggagcagtcctcagtggccctcatcacactggtttggtgagaaagtgtcagaaagaaaggggagagtgctcagttgactcacctgccctctcaccgctcttagatggtgtgttgtgaggcttgtgccttgtgctgtagtgtttagtagaatcattcttggacacctaaaacaccagtttcttggaacacattatttaaaatctttctaatttctaatttccccatctgtaaaatcaatgcaataatagttccttaatagttcttttcggttaaaaagtgcctctgcggagtacagtgcctggaatataacaagtactccttacgtaaccgaaacaaaactcataagtctgattgctataatctctaaggcatttggaggtggactgaccacggatgggcacagtctgaggacagccttgtcctcagttttgcttttgtggacttcctgccagatcctcccaaggctctgcatttctggggctttatgagaagagaactcatccccttggcaagaagtattcttcatcaatgatctcatcatataacaagttattttgaggccactttatagtacatgtgttagagatttcagtaactaactcatgatgacacagacaaatttgaatacaaaacaaaacaatgtcacagcaacgtgatcttccgtgatatcctcatgtcccatgatgtttctttctaagagcacttacttcagtgataaatattatcattttgggatatctccttggcatcagaaatgtttactaattttgaaataaggaaagtgggatgtttcagtcaggtgtgtagttctgatttttggaaaaaaatgaaacccgcttatcttttttttaccctacactgtggctgaaaggtatacaatgtcaaaatggcatttaaaaattaaggtagctatattttggaacattttatccctacctttgaaaattcaaattgttcagaccttcagaaaaattaatagtaatgccacgaacacctgggtgcccatggtgtaacttcatcgattattattttgctttcttgctctttttttttctgtaccatctgaagttgtagacattgtgcatatcttaagaactcatatatcccacataatcacaagtccatcaaaaatatctcttatctaatacatagtccattctatcaagataataatttgaaatatattttcctggataagagtgtcagtaggaaatctggactaacaacggtcaccttcccccttcaagtcctacgtaggaggggaagatgcttaagacaaccacacacagatcagattactgtgaatttgttaagaatttaacaaatgactttagctttccatttaccaaaaattacatttaatatttaataacatcttttaatttctagactttttgagatgtttctagatttctgatagtaccataatatattaaattcactcttgaaaattaaaaaaactacctaatttacacaattcacctatttactcttatagaaattcatgcggtatatcttttggagtaaatactgcgttagttgcaacagagtaatgagaactatgagttgccaaatcagtgatgggggaaatggcaatgaaaataaaataaatactgctggtcattcttcgttgattctatatcaaaggttgttcccctcccgagcccaaatatttaagagacaatggatcagttacatgatctgtgtgtcattttcttcagccataaaataggtaggattatgtcaccatcaacatcacaaggatattaaaaggctaatggatataggatggaattgcttttagttcataggtgccggggcataacacaaatccaaactgtatgcatctcagtgatatccgctatcatccagtgtaacgaaatggttcttagccaagtacttagaatagcctatcatattagaacttttctcacaatgcagcaagtgtctattagtacattttctgaagagtttgtaagattctataaacagttctcccttattcttgttataaatatagcaagattaaatcacaggaaattgccattttataggttaaaagtgatcttatattagcaatttcacattgttcaacttagcaattgtgatagctgtggtctgctacgttgttagctgctactggtataactcagaacattgctccaatattcaaagtgtataagcttgtacatttgcttaggaaagtgctcggtacttgacattcaattcatgaggggtattatcagtataatagtattctgtaaaatccgaatattttcatattaattgctactgatgtttcaatattttgtgcacaacttttctttcatcagcattatgaaaacatatattgtgataagttacaattgtgacataaaatctgcaaaagacatatgtacttttttgggagcttatgttacaaagagattttcctgcacatttctttagtgaagtaagggatttcagaaaaaagacaaagcttgctgttttagcagctctattgctctgttttttaaatgaaacaaaacaaacattccaatccctcaaaagtattaatcttagcaaagctattattttttataagcaatagccctagactttcaaatgagcagcaagttccagactacagcagcacagagataacacagagtcccagagcaattcgttgaccttacagcaggaaataatgatgtatcatcagaatccgcttgggtggtatcgctttgccaagaagcattaggcttctttttcaagtaagatttgatttttctgctatttctagagaggctgggagcatttatatcaatgaaatgcaaagatactcttttattcacctaatatgatcacacctacaagctgaaaacaaagccaagggcttggggacagggccccgactcatcttggggacagggccccgactcatctgttttgcctgtgcaagtctccaagtcatcctcatggaatgggagaagcttttcataataaatcccttaaatatatattcaaacgttaccactgaaaacctgcaagtgtttcagtaccacttgctgatgggaaacaaaccttccctatacgtcttcatcttattatcactgaagagtgtgtgtgtttattcctattaaagtatgtgtgtgtatcttggggctatttgggggctgcatgtatgatatcccccagtaggagcagcatgacagaattataaaatgtggtaaaatgtaattaggttttatgaagttcttaacatagatgctgaggaaattttctaactgatatttttcacttcctgatttgataaaaaaaaggaaaaaaaatagccatggcagatgatatttcaggaaggccaaacaaattttatttagaatttctaggacaaagcatttatgtataacagttctgggtgaaaatggatgattttccagtaacataaaagtgcacactaactgtattgttagcatcaatctgggatatggtcacacctttgaaactctaacttctggggtgcagagaactcagcagggaacagaattggtcacaacctctcattgcagtgaggagtcagttatcctcccaagggccagtgctggcctggggacgcacagtgtcaaaccccagggtgaaaggtcaggggtgctttctgtgtctccccacacacccaccctctatccccagcatctctttcttgtttatcaggacttccgtctcgagggtaattgcttagaacagaaaacaaggttctgttaattcaccactggacaaaggaagaatggcaaaaaacgttgaagaaaagcaagaagggttgtccaagaagcactcaagtcagttagttgttggtttcttttcaatttgttgtgacatttgttagctcattttacctttatttcttccttcagaaaaagaaaagaaaaagcgagagagaatgggaataagataccaattctttcatcatcatatcttgtttcaagattgtaaagccccatgagagataagctctcttattttattcaatgataatggcttagaattctgctagtgtctaaaatgcttcggttatgtttggaatttcacctgaattggaggagtagtagtagttgtaataggacaaggaggagaaggaagggaaggaggaggagaaggatgaggaagagaaagaggaaaatggcagtaacaatagtattactatattactagcagtaatagtaatatttattataaatcattactgagtgcatccatgtgtttcacactgatgtaagtatttttcacgtattaagtcatttaatctttagaaccaccagctatattagacattatactcttattcccatttttcagatgaggaagttgaagcatacaaggttaagatacttggctgagttcacctggctagtaaggaagagaaccagaattcgaacccatgcggccttggcttcagcttccgtggttttcatagctacaatatactgccttatttctatgcctcttccctgtgaaaagtgtccttaaaaatgttatcccaggccgggtgcagtggctcacacctgtaatcccagcactttcggaggccgagccgagcggatcacctgaggtcaggagtttgagaccagtctgcccaacatggcaaaaccccgtctctactaaaaatacaaaaaattagccaggcgtggtggcaggcgcctgtaatcccagctactccagaggctgaggcaggagaatcacttaaacctgggagatggaggttgcagtgagcccatatcgcaccactgcactccagcccgggtgacagagcaagactccatcttaaaaaaaaagttatcccatatatttttcacagcaaggtttgggatgtaacgatattgcagtcaagaggattaaatgtcttttggaaggtcactaaatcatggcccttgggatttaacctaggttttcactcttatttctatttgatcttcaaattcccactatctgagaactcaggatatactgggatctaaaattcaatatgccagtgacaaagcaaaaccattttaattttgggagtattaatatggcatttggtgcgagagatgaaaaaaatatcgtgattttggtcaaagtcacccccaaatggtagcgttagacttggcacttgagttccctgggccttcactcgggtcttcactgcaaacccttgctgcctctccaaaagcctatcttggggttcctgtgcaactgcattaattagcttagtgggaaaataatgaggaaacaagcatgaatgctgactttaaagctcaaaggaaataattaacaataaccttcacggcgaaatgaagaacagagcaggagcccgaaccatactttcagttccttcaggatattgactcgttggagtctgtaacatttttgaagactttactgcatgaggatttctcttatcctgatgtacagctttcttttcttctttattattttccagcaaatcaggctcacaaatggctctctactttaactaactgcctaactgcctgttttaacattttcttatagagactgccgaatctgttcaattactcaaggggggaaaggggagacatttagacacgtggacttaccatgactgtagacaaagcgagctagaaatatcgatggagagctgccctgaactccagactcatctgccgcctagtcatctccacctggatgtctattaccattctcaagcttaaaaacgaccttccaatctctccctctcagactattctcagcacagcagcagagcaatcctgttaaaaagtcagtcgaatcacgttactcctttcttaaaaacctaccgaatggcttcctttgttcctcagagtaaggcctaagtcatcattgagtccctgcctgaccttcataccccgccggccacatccttgtccatcactcccactgcttcagggcactggttcacatgcagtgccttgaattggtcaggcaccctccggcctcccgcccatgtatgtgctgcctttgcctggaatgctcagatacccacatagggcacttgtgcatctatttatgtctctatgcaaatatgccttgctcagcgaggctgtacccttcactcccctattgaaaatcccgaggcactcccctccctttccctgctctatttctctccattgtactcctcaccatatcttatgccttatatgttgtaatcacttattttgttcattgctgtatactccctccagatgtgaactacatgaggacaaatttcagcctcttttgctcatgcttcatttccaatgcagagaacactgccgggcacaaagtaaaatgctcagtgtagagctcctgaattaatacatgaatgaaggatgtatggaattttgttttttaaaataaagagactagatgtgaaaaagagcaagagtgcacctggctacacgagagtactaaggatcccagcaagttaatggcctgacatggttgaatgttctggcaaaaaaaaaaaaaaaaaaaaagtgaatattggctatgcatattagatatgcttacccaaatgagtcaggcaacacttttactctatagaagtacagtaaccgttcagtaatgatggatttctgcatttgtttctcaagtttatttatttttttcttttgagacagggtctcactcaattgcctaggctggtgtgcagtggtgcaatcatagctcactgtagcctctatctccacggttcaagcaatcgtctcacctcagccttcccagcagctgggactataggcatgtgttaccattactggctaattattttgctttctgtagagacgggggtctcactatgctccccaggctggtctcaaactcctgggcttaagtgatcctcacgtctcagcctgccaaagtgctgggattatgggcgtgagccaccaagcgtgaccatgtaagtttcaatttctccatatccatatatttataaactcttctctctctgtcctattccactgtccacagttatgtctgatagcctttaagctcatatccttcagccatgcatctttgggtaggtaactacctctgttcctctttatagagcaaagggtttagatcccactaagcaaatcgcacttcggagttcagcagatgctggaagtttgttggaggcagggcagggcagggcttatagatgtttggggagactgcttttttctcttctgctccaagatactttctcttccttgggctcacaacagcaatttcaaaaaagaaatgatctctcaggtgaaacagaaggccttattaaccaagagggcaaaatatttaggtgagagaagttatcactacattacccttggtatttataatttgaggtgagctcacttctgctattaggtacaacactcacagctgtcacctccttgagtagttaacaggaacgaaaaataatgtcatcagctgctgtgtcacactgttcctctgtacctgagaaagtcctgatgccaacaattttgaagatcactattaaagattattttgctaccattttatacctcgtgtttcattaagttcctgaggagctaatttttatttccagctcaggaacatttgtttttgtaatgtggttcatatttagtggcattgtaccttctcatgcctgtcacctcatactttagcaagatttttgctaaaaagaaccaaagcatcttgatttcaaacatggagaaaagctgagtcttggtacctgttctatgcattaactttccactatggagtgaaaatatgtcccttccatttaatagactctagtgtgtggaagtgaacttataaaacaagatttcaaaaatgtcattcaattgcttcaatgacttattcaaaagcagacctacatgaagctgaaaaaagaaaataaaaccctaaagtatgaatttaggaagaatataaccatgtaacttaagtcagctactatattcaattaaaaaaaaaccccacaaaaaacagccacaaaaataaagaaacaaaactcatttctggttgaaagagatcacaaaaacacaagaagaatttacacaagtgaaatctataatgccccaggaaacagcgttaaactggagtattagagaattgaaaaccctagaaacacagaagtgacagagtctttaaagaaagggtctttaaatcctcctggccttcagaaaaatactctcacatgcatttgagagagggagagatagatagacagagagaaagacagatgggtgttatctttctccttaaaatcctcttagacataaatcttataaattgcttttctcttaagaaagttttccagacttgagattatataacttttaaagctggaaggtctgtcagagctcatttagtccaagaacttgactttacagatggaagcaccagggtcagaggaggtcagtgagttgcgggcaggcaaggttggaccacaggagtcctaacttctcaccctgatgcctgtctctagtaaccaatgtcagagacaacccacgtacaacaatctccttggagagttatgcagtttgctcagagtaaaaaaattcaatgtctcatttgacagatgaataagcagatgcccatgacagtttatctcatataaaatccagtgaaaatagagtatgtgtatcacaaacttttttctttgtaaaataggattacaatccctggtacaaatacaattgtatgtaacagccactattaaaaaacagtggaagctgagtttgtctaaagaagcagggggtggttcctgactcccactctatagtgagcctcaagagggaatcatgaacgcacaactgtgctacccctgcaggaggaagaatattggtatcattttcagcttacatgtctctaagacgacctgaacttctttatctatttctaagccattcatcatttatatggctctccttcccaagccctaacatttatttttggcagtgttgttgggatggggaggtaacacccagggattgagcatttgctctgttccaggcaccagtctggctctccgtgagctctggaaaggagtcaacagagttctggactaaacagcttaataagtgcccaggcacctgccaccaaaaagagtgtggccccaagtggagttggaatgagtcatctcaagccttgaatgaccttcagggagttggcccggtggcttgggtcacaggagaggcaacaccttcatggagggaggcttcggtctgcaaatcaggagagttttattctactgtgactaggaaggaaggtattctatggaattttgggctagtctcatttctcttttgcctcatttttgtaattctgaggttgtgagagtgtgaatgatatctattcacttagattactgtaaatagtagcctgatacatgagcaatttgggggaagggatatttttcagaaattaacaacaacctctttaagtattgatgggggaactgagaaaagtatttgaagttgaggtaggcaacagcttcactgcataaattggaaagaaagtttgtgcatacttacattgagagagtcagaaaagaaaaaagcagtgtttctatgcagtattatgctttagactcctttgctttgcacaaaacagcagtcatgactctcttacagcaaatggcttacaaaacagttgaactttccctttaaactagtagctaaagaaacgaaagccaaatattcaaaacaaaacaaaactgttaggtttcccttcaatttcgaccgtaataatttttgcagaattcaaatgcagccattgaagataaaacatttgctgattatgagacaagagaacattgccccagatgtcagattatttatcgccacagagctgaacatcagaaaccaattcacacatcacaatggctgtagcgccaatcatgagctaccttttctcttaaacaaagtcatattcttcttactttcatgaatttttgaagctgaatgctttcaaggcacttggagattgatcttccaatttaaagtaccatatcagctaaagatttttatctacaggcccagggccagtagctggcatttggaatccctgggagaagacaaacacaggcaattgctgcagtatgcggtgttacgtagctgtatatcagcatactcaccaactctctctgcttctggggaagtagcaaagaatcattcactccctcagtaaagtcacataaaggaaagaatcctaagaaacacactaatgcattacgcagtaggattttatggccaatcaactccattcatccagccctaactaaccccttgcaggatgctgtgttagatacaatgaagaattacaaaagaataagcagtggggttatgatttacccaaaagataagtttcagtgagaaaaggaaaataatattctgaaatatttgaacatagtaaacacaacagagatatttcttagaactatcttattttatttattttatatatgttttgaggcagagtctcactctgtcacccaggctggagtgcagtggcacaatctctgctcactgcaaccttcacttcctaggttcaaatgattttcatgcctcagcctcccaagtagctgggattacagatgcacaccaccatgacagctaatttttatatctttagtagagccagggtttcaccatgttgcccaggctgttcttgaactcctggcctcaagtgattcacctgcctcatcctcccaaagtgctgggattataggcgtgagtcactgtgcctggcagaactattattatcaagacactacccttttatccatggcgatcacaattaaggctctagatacaaatagttttggaacagaaaaacataaatacttacccaatccctggtagattttgcaagagacgagactcaattccactggaattcaactaaattccagtgattccctgatttatatttgtactttgtatgttgtttctactcgcttcagttctcaggtttggcagcctgagactgccaccttcatgtcagtcccttactttccccattcctttctgaaattttcatgcttcagtgaagtgtttccaccccttccacataacccatgatgcacaataactttgaagatcagcacgtttttattctcccacattgtactatgtcaggcagggattgtcaataggagtaagaacaagactcatccacggcacaagtttcacagaaggtaccttcctcttacgaatttggaatcctgatttctcgaagtgattgtcccctccaagtgccatgatatacaggtatcctattttgtatagagagctgcttctgttgatgatcctaatttttaacaattaaatggaaactgaaacttgggaactgaaaggttgattagagatggaccaaccggtccaatctgacttaaaggtaaggacagttatgcccaaagaaagtaagtatcatgctgatggttattcggcttgtaagcagaagctttatcactcaaaatgttaattctgagatagccggttgttcttaattgagtcaggtcgaatatctaggtcttattaaactcaatcaggacttctccaaaacatcacttttatctccaggtatatttgtcctgcatttgggagcactacccaaaatctaaaataatgctcagaaccatatcatctcatattatccagaggacagacattgagaccaaattctaaggtcaggaagcaagaaatatgcatgtttttgtgttctggtttatgaaaattggaaagagactaaagtgaacacatttccttcccatatgactctacttcctaattctcagagaaacacacaatgaatcaagaaaagctttggagttccctttgattctttgacagctgtagaaacacgaatgaataagacaggacctgaagtagcttccttgcagaggaaatactgacatacaaaaacatgaatcaagacagtctgtagtaaggtgctaaactgtatgcaacagaatggagttcaatggaacgtaatctaggaagacacgctgagccttgaagaggccaagggagaaagcataaaggaatgcacagaattagcatgatggactagtgaggaaaccagcctgggcaaagcagagccgagtgctggggcacagcaggaaataaggcaggaattagttttacgtacgcccgattaaaacctctgcacagagatttagacttgatgcattatggaaaagagcgcacagtcaagttcatctatcctttagattgccttctgccatgacttactgaactacttgagaagcagaggtggaaacaaggaagctgccaaatgaatatgaaaactcattttcattagtcctaagtggcagatttctgagctcttaattcttgtgtttattcaacagaatattgctgtccatcttttccccaagtaaactgtatttttcttctctccttttgtttcgactttcttttaaactgactctctctctatgttactctctctctttgcaactctatgtatatacagccaaaagagagatatacatatatatatatatttatatacagatgaaaaaaaaaatatatatatatacaattttctttccaactgtagtcattagtgaccactattttccctattcagtaaagtgccaattttaagcatggggaaaagagcaccaccaatgaaaccccgcatctttctgcacagttccatctatcctgaaatctgggctattgcttagaaatcatctccacatatgtcaggtctaacactgaagccaggagttgttactacctaaacctctaagtgaaatgataaaaactatacttttccccaaataaactaaatataaatttaatgttttttaacttttgaaagagaaaacatataaaaaagctatttttaacataaaatattagagatattttatctagaaaatttcaacaaatcctaaggaaattcaatatcaatcattatttggtttctttagtgagagaatgaaaggtccgattttaccaccctaaccaagtttcttttaatacttatgtgtaagaacaaggactgaagggaagcacagagggctctgacaactcaaggcagctaataaggatgtagatgctaattcaagctgaaccactgactctccacattactataagcaaatcattctgatgccctgctcttctggccagtcctggggccacagtgaatcaaaagcaatactatataatagaaatcatacttcttctgagatcagcttgggcaacaaaatgagatgccatctctacaacaaacacacacacaaacaaacaaaacattagctgggcatggtggctcacgcctgtgttcccagctactcaagaggcttaggtggaagtattgcttgagcccaggaggtcgaggttacagtgaactatgactgcattactgcattccagcctgggtgacacagtgagatcccctctataataaataaataaatacataaaataaaacaaaaatcatacctccgtatataagttctcctacttaaacagaatttcttttactccactgtgttttgtaaaatttactcagacttactcaacttagattccttagggggaaatatgtgggtatgtgtgcatgtgtatatattaaaatgtactcaactcaaggtccttctggggaaaatcatacatacgtgctgaagttttcattttcttgttacatgagttttttttaataatataatctttgataaaatatttcagattatactaatatgctagcttttactctctcctgagagaactttcagtagtgaaactgtataaatcactgggaatgcattttccttgaaaagcataatgtgctataaagacggtttcactctttttgctttttaatgccaggcttcctcgatagcctgagggtacaggaaatgtgacattaccaagaagaagggcgaagacagctggaaaggaggagaaggaccataactgctgggttcttccccagcacagagcacgtgtgaacagcactgtcaacactcacacagtgtgactctggcatagattctggctgagacgaacagcagagtgacacactgcccaggatgtgaatgttagcacgtgtactcacagtagaaaggaagaagaagcctacagaaagcagagtaagggagatagttatggttagttatgtttacactgataattgtgtaaaccactaataattccttgaaagtgtaggctacagaattgccagggtaagcagaaagctattgtgatctataataaggaagtgagagaaatattgagtgaaatgtccaaatggcatgtgggatgcctaaagcatcaacatggtaaaatttagaggctggaggagggcacttagtgaagtcttatagttcagaagggaaaatagagtctgatgtcaactggttacccggttaaatctacaatttggaatttataatatacagtgaatgtatatgttactccacttggcagtatctggctaaatagggttaaataaggaaattgttaaaatatttagattgtaacaaaaacttattttaaaaacttattcatcacagaaagttatacattatatcatttacatccctcaatgatctcctagaatttttataaactctggttgaagacctaaagctcttttaacaaattcatttttttctttttcttttcctttcttttttttttttgagatggagtgtcgctctgtcgcccaggctggagtgcagtggcacgatcttggctcactgcaacctccacctcccaggttcaagcaattctcctgcctcagcctcccgagtagctgagactatagatgcatgccactatgcctggctaatttctgtatttttagtagagaccaggtttcactatgttggccaggctggtctcaaactcctgacctcaagtgatccatctgcctcggcttcccaaagtgctgggattacaggcgtgagctactccgcccggcccagttcattttctagcaatcgttatggattacaacaagagttatacatatgtgtgtgtgtgtgtgtgtgtgtgtgtgtgtgtgtgtgcgcgcgcgcgcgtataacctatgttgaattctgtcagcaaaaagtaactttatttatttagcttggataagcatgggactcacccaggctggagtgcagtggcacgatcacagctcctggactcaagtgatcctcctgcctcagcttccctactagctaagactacagtcgtgcgccactacgcctggctaatttttaaattttttggtagagacaaggatgaggtctcgttgtgttgctcaggctggtctcgaattcctaggatcaactgtttgtcctgcctgggcctcccaaagtgctgagataacaggcttgagccaccacacccagcccaggatgcctgttttcaacatagccgtcaacaccacctcttgatgaatgcccattcctaaagtttccatttttgaaggacaaaatgttttgatcgggagtcacgttttgttttatatcccatttcccttacagccagtaagacttatcaagcatcacttttacatacgtgcttatgtgaaaaatacaaaaaaaaagcatgatataattgtgaacattttcctacacaaagaaaaatataaacaccaaagtgggaaaagtgaaaaaatatataatattaaaatattacacatggcaactaaattatgttgtgagttggataaaattaataacatttaattgatttcatttcaatagtttcttaactgatcatcgttcattacggcaatactgctccttattgtagtgcatttactcaaatagaaatgatcagcaaaataaaggagatgaaagtactaagtttctgaaactttgccttttcctactctttggtcatgaacaaaagccctgcatgatcttaaatcttgtggaacaataggaaccaagcagagactccttccaacccttcatcttcctacactcctaatgcaaatctcatagaatgtggaccttatagatcagttaggaatactgccaagcaaattctgcaatgcttttacattattttatattttattagtccccaaagcacctagatatatttgaatatattcgttgtacatacgtgcaggacatccgtgatttttgttttaaccgtgcctggtacataaatggattgaagcactcctagcaatcattcaccctccagatagtacgtagttaacaggtggggaaccactgcgataggtggttaggtcagatctagagacagcggaggtgaaaatggagggaagagaagaaagggaatctgagaaagccccggtgtcagtaagaggagcctagggtgtgtgggatggaatgtggaacaaactgaaagatgtaatacttcactgttttcatttgaaataactcctcaaaaagtcatttagaagacagtgaattagacttgtgcctaactcatacacagattggatactctgaggtagagaaggcacagataaattattcattaattcacacagtcaactttcctcctggcaaatggtagacagaagattgtgatctgaaatttttactgagattacatattcagcagttgtagtggcgaggcttagtttctgggtctgcatcactctgaatgaagggcaatgtgatctctagagataaaccagattgctaagaaatctaaataaccccttgagcttcactggcttgagtggttgaccaatgccattacatagtgtaacactcaatattcagcagcaaggttaatgtgttttgatagataatttaaattatagaaataatataaagaacaaaaataaaatagttagctaatttcaaggggtctattgtgcccttagagagaggatgagttgattaacgaagtagacatttccaaacgcaaaacatctaatgtccatcagaataatctctctgtgttaggtctactgctatcttttattattctattttatgcattaaattctctactactttctaaagattctagtctataatatggaccagacctcctttgaagatgaaaacaattttatataattaaaaggtcacaaccatgaaaatcaagtatattatgtataaactcagggtcatataagttgaaaacaagaagcacctattttatggttaaatatttaataatgtctccacctctgcctaacatgagaacaaaacaaattaacattatcttctttaggagaatgtggttcagtttatgtaaattgttaaatggtaaactgaggcacaatgacatgttaaaggcaactcgaaaccggaaatgggctggggactctgctgagggaacacaaaggcaaagctttttaataggatgaacacagaggcaaagcaaatatttgaggggttacagttatacagttaccttaccatgctgctggaaagtcccaacctgcggaagtataagttggtgacttctcattgatcagccttaagtttcatttttctttaatataagcatttacaagaaaaagctcaagttaagtttcacttatgtttgcaaatcaagcaaagttaaggtgacttatgaggcctgtcttagtcttctcacagattcttcaagtctccattttaatttattataacgaaagatatattaaatataaatgaatatctcatatggctaaattgcttttattatttaatacccatatttctcgataaatatcagatatatattttatatgggataggatgaaacatatccatgatgctttgtcccaagatccaaagacatgcctatcaaataggtaaatagcaaaaaggcaaattggtgattatactagagacaatatctgcattctaatgatctcatcaggaactaataataagacatggtgaactggataatacaaacaaatacacataggttaaacaaaatggaaaaacatccagaaacgattggaaaatcttggctacaaagtaggacatctcacaaaacatctagcattttaattggctatagatgcaaatcaacagcataacacagcttaccaaaaagtgaacacgaacaagttgtgttaatgaaatgagagtgtgtaaaggacaaacacgaatcttttcatgccctgattctgtcaggaaacctctagaatattcggttcaatgtctgaatcctcatttcaagtggtacattggtatctaaaaggcagagtatgtccatgatgggatttgcactgaaaatatgtcacagaggagagagagaaagaaagggaatagctgctgtgcctgaaaagaagctgaactaatgaaaacagggtagccgtccaagtcggactctatgcctgccttgatccccagctctcacaaacatgaagtgatcacacgcagcactcacagcctccagtgacctggcttcccccatcctctagccctgctcctctgctcccacttttactctatcttctagcattatggagccccttagattttcctcatatgctgctgtgtctccatgctattttgctactattcttccccttgaagtgcccttttacctctgcttttcttcttcatgggataaatcatcctcatgtttaagactcagctcaaacttatctactctagaaaacattttgtgaccccccttcgtccctattccacctctctgtcccatccaatgcccctcctctggaatcctgtagcatcttatacatatatatttttagcatatagtgaattaaaatgatctgtgtatgactgtcttccgtagctggtgaactgctaagcagagattctatctgatagtggctgtgaaaagacatctgatgaaatgggctcgatgttcctcatgctaaaaggtaaatgaacttccttaatcacaaatgtatatactaagtgcctactgagtgccaagcagtaaagctcagtgagctagacaataccagaaggaaagaaaaagtgaacaggaactcatttaaaaatgaaacaactttctaataaccatatttgtctaaagatggaaaagaatacctggtaataaagtatgttaaccatcattgatagtgcaaggagtactatataaaaatgatttcatgattgggaggctatattagatcgttaggtactttctaagatttcttccaatcctaacattctatagtctcaactacttattccccatttcaaaggtgaaggagatccattttcatctttaaatgacacatccatagccatgtagttctacatgtaattaaaaccaaagctattcaaagaaagcttttgctgcagagaagcaggatacagccagacacaaactgcaaaaatgtgagctagtacttagcacttcttctatctaattcccttaattaagaaagtaaaaggaattcccgggcagtccctgtgtaggtgtgtgtgtgtgcacagtgtgtgtgcatgcagggatgctgtgcatatctgtctaagtgggttatattatcagaaataactgaggagaagacactgaacccttacagtgtgcccttgcaccgtcaggaatcagtggccacactgcgggacaaataaaacaaatgaatgcattttgtactacatgacactaaattaaatgattgttagcatttaattacttgcaaggaaataggaataaaactggtcattgttcaaatgactcctgatcctgtgtctagacatgaaaagcaatagattttaaaatcctcagggacacagcaacatccaggtgctacgtgggcaacacagcagagtgccagtgggcacactctctgtacccagactccctgggtttgaaccaccctcagtaatccctagttatgtgtccctggcaaatttactcaatttcagcatgcctctgtttccatatctgtaaaatggatgtaatattacttatgtcatagaattgagagaggaggattaaatgagatcacccctgtaaagcactaagaacagaggtgtaacatggtaagtattcacaatattgccttctattattattattattattttattattttttttttgagacgaagtctcactctgtcactaggctagagtgcagtggtgtgatttcggctcagtgtaatctctgcctcccgtgttcaagcgattctcctgcctcaagcctccggagtagctgggactacaggcacgtgccaccacgtccagctaatttttgtatttttagtagagatggggtttcttcatgttggccaggatggtctcaatctcttgacctcgtgatctgcccatctcggcctctcaaagtgttgggattacaggtgtgaggcaccgtaccgggcctgccttctattattataccaggacgcattttcatactgagtggttctgcaactatcaatacaaagtaaaataatattactgactagaaaactaacagagtaggtatctttccgtattgcttttaattaccaaaaatgcccatatatgagatttaaaaaattcttccattcatttaaatgaattcttattaaaatttgtttgaagtgatattttaaaataatttttaagtaaatattaaataaaatgcataatttaagaaatacaaaaagactttatgaatagtcctaaaatctgatctactaccaaatatggccaaagaggataaagaaaattctagatgaaaaatacttccattaaatgtttaagttgaataaaggcaaggcctatgtcctcctcctcactttatcttggtaattggtgcccagaacttcaatatttaaaagaaaaataaatggataaatgtgcaattaatcaattctggttcatttcagcatatcctatggaagggcagttgccatcaaattcaataggtgctctttgtacatcatctttgtatttttttaatgtgttttttcttttagatagatttcagttacttcagaacattaaactacatgaatgagaagatatgatttataaacattttctctcaaaatgaatgactccctactcattaaaaataatttggttaatattggctcaactattatgataacgaaagcaaatagtctttctgaagtcaacatttctttaagcatcacatatgaagatattttcccacaacttctcataaatataaataagtcatatgtgctttgttaaattacgttctgtaggaccagggttggtgaggcaaaatcaattataaaatggaaaattcataaagtccatccaggagcttcctgtatttttaggaaaaggatgttgagatttcttggagccacagaaatccttgtatattgaactaaaaatagagagggaaagagaagatgtggaaagtgcatccatttgctctaaacattccaaggcaatcatttgcttttctcatctccatcctcttcctctaagccagcagatgtatgtgctagcttggctcccacactgaactcacattttgagatccacatccggtcagaggaacaaagttcaatgtcattgttctctggtaagtattgtgtaagattttctcttaatccttgatgatctgtcagtagctagattcctgcccttgcatcaataactacttcataagactcattcttcaccttcactgaccttcaactctacactctacctctgcctcacccttggttcccactctgcacttcctcccaggcagtctgccacctggcttctctaactcctgccttgagccaaatcccgacaggacttgttactttcacttgctcttttttcctcccattttagcagccaaggatgggaattacacagcgaaatgcaggctaatcagctaaatctagattaaatatgctagtccttggggaccttgagctgaattaatggaaaccgaggtttttaatgttccagactaattttggaagctcacttccagcagaggcaaacttgaggctgtccaaagggagcagatggcaaggctttctccaggtgcaccaacctttgaaacagccctcggcaaaaccatgaggaaggtaggaagattggaatctttgaatcttacctttgaatttccttttgtgcttttcacttgctttccagtgctcccctgcctagccaaaacatacccacctagaacttctcaggctccccttcctttctctgtgcatcagacaaaattctttctctcaaataatgacagatttccggtaaatcttaatcatattaatgtaatttttccttccttccttccttccttccttcctttcctccctccctcccatcctctcttcctcccttctttctctctttctttctttttgacggagtctccctctgtcacccaggctggagtgcagtggcacgatctcggctcactgcaagcttcacctcccaggttcacgccattctcctgcctcagcctctggaatagctgggactgcaggcgaccaccaccacacctggctaatttttttgtatttttagtagagaccgggtttcactgtgttagccatgatggtctcaacctcctgaccttgtgatcctcctgcctcggccccccaaagtgctgggattacaggtgtgagccactgcacccagccccttccttccttccttcctttcctttcctttttctttgtttcttctttttctttctttccttccttccttccctccccttccttccttccttcctttcctttcctttttctttgtttcttcttttgctttctttccttccttccttccctccctccccttccctccctccccttccctccctccctccctccctcccttccttccttccttccttccttccttccttccttccctcctctcttcagtgtctcactgttgctcaggctgcactgcaatggtgcactcatgtctcactgcagccttgacctccccggctcaactgatcttcctgcctccgccttctcagtagctgggaccacaggtgtgtgccatcatacctggctactttttttgttttttggagagatagggtttccctatgctgcccaggctggtcttgaactccttggctcaagcgatcctccctcctcagactccagaagtgctaggattacaggcatcacccaccatgcccaactattaatataattaacactgaatagttcagtatgaggaactctcttaagatattttgctcttatagtgtgtttattaatctcagtgatataatggaatttgaaatttgtaggatacacaaaagatcattttgaccatggagttacttttcatttagctgatttttcaaaataaattatattgaataaaactacccattagccaaccaacctccatcacttcttcttgcaggccctttataagtagctctacactccatccaactatacagccctcaagctgggaaagaatgtaaatttgagtttgccacagataaagcatgaatagattccactaatcacttgcttggatgataaaaatacaatgccacagactagagagcacagaaaatcactataatggcaatttgggcataaatgcttatcctaagaactggagaactcctagtgggctaaatcatttttgaaggcctcgctagatcaacggggagcacagagcataggtatcttcagagctgactggggaggacctttgcttctttatttgtctgttcacttttttctttatttccctgattagcaggcaacaagaggagatcaagaaagtaaaaataattatttcaattgctctttcatacttccagcaaatttctatctaaagacagcagacagcacaagtttctccaggtgcaccagttgctggaaagtcaaaactaaaagctcaatgatatttgggtaaatttcagatgattacatacatccatgtcttatgacaacaatgatcaaaaatcaactgcattctgggcaaacaagctgtctgtgatttttttaaaatgatttttgaaatcagcatatgggctatatgtataatttttagtaactcattagataacatttacaagcaaataaaagactccaagtgtaatctttatataaatttggcattttgatcaagtctgatatccatacactcatctcaggtgctgagtttactaatgtgctcacccacccactgatagctgccttagttgaacaactcttaccttactcttttgcaactatttgccttttctttttcttctgcctgactttttattaggtttgtgtattggtttgggacattttatgacaatagcttatcacaaacacaatatcctgatgagactgaagaccaatatttgtttctatcactgtaatgagtgtgtgtgtgtgtgtatctatctacctatctaatgagcctaatattacagtcaactgctgtcttaatactgtgattaatgctatgtcttacctgcccacctgtgcacctaatctttacaacttctaatttgtggcagagataaatggactatcaatgggaaactacaaagattacttgctattgctccttcccttgcagaaacattttgttgccctacaaattactttggttaaactctacagttacattgtctggttataaaatgcttaatgggaagtttctccccacctccatttgttttaacaaacacaagaattagaagatatgtgagtaatcataaaatctcatcttgcacccaaaggaaatattcctgtcagatggtatattacttatctacagctgcatacaaaattactccaaaacttagcaatttaaaacaacacacatttattatctcacccaatttgaggtttgggattgtgggagcagtttagttgggtggttctggctcaggatcgcacatgaggctgcagtgaagctgtcagctggggctgcagtcatctgacaactaggctgtggcacaaggatccacttctacaagctgttgacaagaggcttcacttcctcactgcgtaggtctctccacagggccactcacaacatggcagccggcttccctgagtgagtgatccatgggagtgagagagattgaccaaaatatacgatgcagtgccttttacaaccaaatcttggaagggacatactatcacttctgccatattctattggtcacatatcattactgaaattccggacaagatcacacaaaggtgtgaataccaaccaggagagggtggtgagcagaggccatcttggaggctggctgtcatagatgtttgttcagtttctgacaggatggttactacctcaggtggcagcctattccatctctgcacaattaaaactgttagaccagctcttctcagacaggccaaaatttaacttcattagagatgaggggaaagaaacaagtacaattcccttgatgttgatggcttatatattcttgtagttattggaatatgaacatttcaaattgactgctatttttggaaatttcaaaaaggaataaacagtattttttaataattttattctacagtgtagttaaatagaaagtatgccggggaagaaaaaaatagtgaataaaagagaaagggagattatgaatatagacagactggagtgaatacctatttgatgctgaaataggtattaggataatatttatcccacaactcttgccacaccggctgtaatttatctctcctctcttctctccttatagtaccagattaattttctattttctagttttaacagcagggtttgtgggttacagccattctaatatcttgtaactacaatttcatttatgtaatttgcagcaaaatatggcagaattgttaggtttctataagaattattttacatattaaatatagaaactattattttgggaagaaataattattgaacttgaaatactccataaatacatattcttacttcaaagataatagatttcatgtctgcttcttgcttgaaaacatataaaaaccaatggactaaaatcaatgtatttaataacttttacatcggtccagtaccaattttaagaaattacacaatacagagatcagtaaagaataagatccaccatataaataataataattttgaagagttcttttattcagtattgtgttatatataatgtttttcttgcttagctattagcagttttttggacataatttgaacaaagccaaaatgtaaatgtcagattgatggattattaaaaattggcaaatcagagtagtcccagttaatattaactcttataatatcaagaaatcccttttaaaggattaaataaatccattgctacttactgaatttctcccatattgcagtaagatatagtaaatgtatccaacaaacgccagcctgatctttccatatatctacttaattttcatgtaatattgactacaatgttgactccctgaaagtataaataatttctctttggaaaactatcacaataccattcatattctaatattcatattattttatatatacatatatatatatatatatatatttttttttttctttttgagacggagtcttgctctgtcgcccaggctggagtgcagtggcgcgatctcagctcactgcaagctctgcctgccgggctcacgccattctcctgcctcagcctcccgagtagctgggactacaggagcccaccaccatgcgcggctaatttttgtgtatttttagtagagacggggtttcaccgtgttagccaggatggtctcgatctcctgaccttgtgatccacccgccttggcctcccaaagtgctggcattacaggcgtgagccaccgcgcccggccatattctattattattttattttcaccgagaaataaaagccatttgaaagggccattgacatagtctataattaatgttacagctataaagttaaaatggccaatgataagtctagttattaaacatcacagacattctaccaatgcatacatttatctagaaaatgctagggctgactatgagtactagggggagaatttcttgagttctgactaattttgtcctgaacttatgtctgttttaaattctgtttgtaaagtcttctttctaggttccctttacaaaggccttttctactgcagcttgtttcactttagcatgctaatgattgaaatagaaatttatgctattcacaataggatccttcacatgttacagtagcatagtttaaatgttcagaagctctgtgttaaaatttagtttttgacaaaatggctcaagttcctcttattaaagaaccggatctctctcattctctgagaaagtccctttgtagatgagatgcactactgcactgtgtcatcactaatacagggtggtttcattcgcacttggcacctctcaggtaggttgttttgcaatggctttatttcattttcccctcttattaccctgcagcttatttaacagaaagtgcaaagccaagcctcactttgttcttcctctggggacaacctactcttaggcagcaacatttctccttccagctcactgtgtcaatgtctctcccactagctcaaatggcatcatttgggaggcgtataaaacatttggtgtaggacagatgatttgttactttaaaacttgagtaagtaacttttcacgagaataattaatttagtgataacataatatttttccaaaatatttcacattgatggtttcatcacacaaaactaataatttttaatgtttggaatatatttttctgaagaggaggctttattgaaaataaagaacacttacaagaaaataaagaacacttacactgtcccatccctctccttccctccaaatataccttccaaagcctctgacaagcattctatggctattactagtaggttcaattttaatttagtaatcaggtgattttataagcttactttccaaaagtaaagttccaagaacaaccttttatagaactgcagtcatgcatttagtgtgggcatttctgagatgctgtttgcagatgttgacttataccttaagtcgttttcatggtgaatgagattccttaatcactatgtccttttattgtttgatcctatcactagaacattttatgaagtaacaattttcatcagaaaatttttctttcccttgtggattattttccaaagcttagaaacataattttaaaggcaggtttccatcctgactcatattccagaagacacagaagccagctgattcacaatcccctctataaagggggagtattcttgacttagaaagtggttgacagctttctccaagctggtttcacactagaatcatttggggaagttttacaaagaactcaagctcagatccaatcccgagaggtcctgatttaattggtctgtggtgagtaggccccaggaccaatatttttgaagctccctcccgaagtacttctaatgattgttaatcattaacctccaacctctagttggaacatttacaaatactttaccatgttgttcttgcttttcatgatactacctaatttcacatatatgaagtgagagcaagtaaggcaatcttagagaaacatatcatttgcctggtatcctttgggaatgattattatgaatgaaagaatactgcaaataagaaaaatttggcctaccaatggtgaatattaaatatttaaccaaatttgttgggaatttttctaataaatattatgtaagtctataccttgaagaaaatatactaaacattatttaatcttttcttgatggttcaatattatcattgtagacacctgtagttgtattagcttgtctttgtaatatttctactcctccacttaatggtatcagagttgtgaaagtttttggaggtggtgattcttatcatgcctcagtctcaattattacttcttagtgattttaacccacctatttccctttgcttttgacctttctgcttcaaatataatgatgtaaatattgattatgctgaaatgacttaatatattttgagaagaccttaaagcttgagggaacaggtaatcatgctcattaaatcaagtaccctttttgatgcacacaattcatgtttagtaggctctgtggtgagaacacaggaatggctcttctgcaagagaaagcacttgaagactgagaccaagtttcctccttgcaattctttatccatttttttctttcatgactgtattcagatattttaatattttaggcttatgatctgtgcagtgtattccaactttatgaagttaggctaatattaaggtagaagagtatgaatagtattaaatggtgtattgcgtaagaaatatatatttatctcacttcttagaactgcgtaattctttgtctacttctgtcattaaaattgcttctgaagaactgtcatctacaaacttatataagatttcctcatctgcagcttttttgaagaatgcatcaaaaagttacagtataaggtgtgatgtgaattcagtttattttacctttttttgttctttgggttaaagccaggagagatttttaagtatgaaatatatatgtaatattagatgaatatattatctcactaaatagtatccctgagctaaaactccctgtcaaccatgcagagcaacatagcagccatgtgatggcatttcagttacaaaatactggaaaatgttaaacttgtcaaataataatccgacttagtcccttagcccccaggctgagtaattccaggctattttctctgccatcagcaggccaccatgagatcagactgttttgcagcaccatatgaagtaaaaagccagagacacagattcaacatatataaaaggatttcctattgccctaactcttctacgggaaagcgttttatagtggcctacattgtatgccctcaaaatatatgttcaagtgctaacccttgaaacctgtgaatgtgaccttgtttggaaatgggttctttgcagacataattagttataacgagatcacactggttcagggtggcccctacatccaacgacaggtatccttacaagaagaggagaggtcacacagagaaaaccttgtgaaggcagaggtggagactgcagctacaagccaaggcatgaacagtaaggattgctgggagccatgagaagctaggatgcatcaaggagggattctcatcaagggccttcagagagaggaaggtcctgccagcaccttgactttgaacttctagcctctagaactgtaagaggataaatttctgttgctttaccacctctccacaccctatttgtggtaatttgttactgcagcctccaggaaactaatacagcattgaaacaaaaactttccattatagcaaatttgagtgtggagaaggaaagcaatcatttgttaacctctcaccatgttgagaaatagcctgatctcttaaaccctccatgcaccctgcctctcccgctcttgcttccccagcatacatgggtctcctcttggtacttgctctccttttcctggtcttggctgaaccaagaaatccctcacatactttacccagcaccaccaggtattactgatgatgttccatggcacagcattacaaccattctgtgaatgttgtttttacagaatgaaagcaacactgtcacctaggctggagtgcagtggtgagatcatagttcagtgtaacttcaaactcccgggctcaagcaatcctctcacctcagcctcctgagtggctatgactacaggtggacgccaaaatgcctggctaattttttgtggaaatggggtctcaccctgttacccaggctggttttaaattcctgggctcaagcagttctcccaattcagcctcccagatagctgggattacaggcgtgagccactgtgcccctccttaagttaatttttacatatggtgagaaatgggagtccaacgtcatccactttgttggtgtgtaattgttcatagtattttcttacaatgcttttttaatttttgtaaaatcactggtaacattcctacttttacttctgattttagtaatttgtcttctctcttttttttcttgatcatcagtctagctaaaggcttgtcaattttttttatctttctgaacaaccagcttttagtttcattgatttttactataatttttgttgttttaaatttcactaatttctgctcaaatctttattatttgttttcttctctctcatttaggtttagtttgctttttttttttcctccgtcttaaggtggaaggttaggttatttatttaactcttcttttttcacaaaagcccttacggttataactttccctctaagtaacactttatctgcattccataagtcttactatgcttccttcattttcagtcatctcaaagtgtttttggatttcttttttaatttcttctttgacccgctggttatttaagagtgtgtcatataatttccacatatttgtgagtttccccaattttttcctgctattgatttctaatttcattccattttggtcagaaaatgtactttgtattatttcttttcttttaaagttgttgaggtttgctttatggactagtatatggtccattctggaaaacagtcctcttccctctcactttggacagtcgagaatttactcaatatctttaattctaacttaaaatagaaataatatatagccaattcttcactggaatctgactcacattagagagctttgatattataatcaggctatgtttactcaaatgtcaatacaggtagataggcactacacatccatgcaggcctccttcatttaaatcattgcagaaacttgcacttgtaatttaatagcatcataattctgacagctataattgagaaaaccacaacaattgagtatttgaaaaccccgcttttagtagataagaagtagaaatgatgtttattttgtcataaatgaacacactaaaccatttaaataactgcataagtaatatttgactggacttattatagagtagtgagagacaaaaccagtcctgaccatgaatgttctaagaaaaaatagactccactgatcattaatgggaacaaattggtaagatgctactaaataatatttttgaaatttaagaaataatctttcaaagaatttatcaaaatgggactgacttctaatttgggaaattggtgaattaatatgggaatatataataatcatacatctatctgctagcaaattgtaatcagcattataaactgtacttactagtaatgagagagtatcaaaatgcatttaaaaatcatatacttttcattatttccattaaggtgtctggtccccatgatgtctctaatgactttgaccagtaccgtcccatttgctcactccactccagccacactggctacttgctattctaggagctctcccatcttttcactgagtgctctctctcacaggaatgctcttcccttagagatcctcgtggtgaattccctcatttccttcaagtctgctcaaatgttacttctcaaacaggtatgcatgtatttaaaatcctatttgaaattcaacctgcctccatgtttctcccactgttggcaatcttgatcctcttactctaatataagtttttctatgttgaataacatttatcattttctaacaccctccataatttacttgtttattatgtatatgttttggtccttctccccatgctagaatgtaaatcctaacaaagcaaggattttagctgtttttttttttctctcgctagaatatcataaatgcccaaaactgagcatggctcattcttgcaagaaatacttattgggcacttactaaatgctaactattgtgctagtcatactattagacgatgtgttaaaatttatgtgttcactgctctcatggagtttatttctgagtggcagagatggaggctaattaataatcatatacaataaaatataaagttgagatacatatttattctgaagaaataaagtcttatgaaaatataacaaagaaaatatatccagaagtgagttcattgattagaaaagcctttgctcaaatatcagaaagttattcttgaactgagatatgaactacaagcaggagtttacaagggaaagagaacatgcaaatattctgtggctaggaggagcagaaaaaagagagaggactatatggggtagcaggagggtatgagggttcagccggaaaagaccttatgggctgaatgatagttttgtctattgtccaagaaaaatgggaaaccactgatgtgtctcttttttggcggggggtgggagggggcttgattttttttttttttttaatgcagggcaggagacagggggaggcataagaaataggatcataattatgttttgatgagctgactttgactttggctatagtgtggagaattgtaatgagctctgattattcaggatctttttagaatttctgtttatagatggaggttaaaataagttaaacaaggctgggcacgttggcttatccctgtaaccccagcactttgggaggctgaggcaggcggatcactcgaggtcaggagctcaagaccagcctggccaacgtggtgaaaccctgtctctactaaaaatacgaaaattagccgggtgtggtggcatgcacctgtaatcccagctacttgggaggctgaggtgggagactcactttaacccaggaggtagaagttgcagtgagctaagatctcgccactgcactccagcctggatgacagagcaagacaccagcttgaaaaaaaaaaaataaacaaatatattttctcataggagtatttcatggtaaaagtaaaatgtcttacagtataattctaccaataggtaattttcaaagtctattttttatgcataaggtcagagaaactcaagaaattaatatctggtactctaaattttgtgtgattcttaagtgaagtttaaataagaaatacagatttctgtgtctgactagagttgtatcagtaagtataaatagaaacagtaatgcatatgtaagattttaaaaaagtgtatcttaaattatttgttaaatatgcatacatattggttccagcctcattacacatttcatttgcttgctagactttaatgaatatattttctaacccataaataaatttgtgtagtaacttagctcatgctgatttttaaaaagaagaaaaagtttaaataaaatctcatcaccaaaacagtgggaggcttttttccctgctagtataatggcatttgatgattttcctgtgtatacacgtgatatagacgactgtgagaaataggcgtgttccaactgaggactgtgtgcaaaggatgcccttgtgatctaataatgctgcaaatttctgtcagaaatagccttgatgaatacatggaattgcataatgttacttaacctaaaacttgcttaaagaattcttgaatttttatttaaaatccagtttcacaaatggagaatgtgtgtgtgtgtgtaagcttatttgcactgtttcactgtaatacgcattctgataatttaaggatgtcatggttactttgaacccaaggcttgttagcattctgaaagtaagaatagtttctgtgggttttctgtggggtaagatatatgtcataggttccgtgaaggatgtctgtgagattaggaaccatagaatgttgtgggtttatttatttattttttattttaaaaggaaactttaaagttccctttaatattcctttgtataaaacccattatgaaattgcacttgttctaattctcttttttcggttatttagtgcaaattatttttggtggattgttatcccacattactgcagccgagacagtttccagagatactactgtgatagaactcagcaggggtagcacaaacctatctcccactgtcactttatgtattttggctgtctgaatttttgtttgtccacatatcggtaatattgcattaaattttattcttcatggaatttcagcccttggaaatacaatgtctgctccactctaaaagccttttctcccaccttgttatcctaaaaacctactgttgagcagtcctttacttaggaacctgaaaagtgggaaagagattgcatttttttttttcttagaccattggacgtgttcaaattgatttagaagagaaaagctacttacctttggctcttttttattatttttattgttgttgttttgtatttggtaacaatacttttgttacaaatctatagttttttaaatacagcatgttatgtgagttaaatatgtatacaaaaaggctatggggctgatttttgcatttatatagtacttcttttctcagagtgataaactaaatgagtattatggtcttttatttttaaaggaagtttgcttacatctgccttttattttattttacttatttgtataatttaagaggtacaagtgcaatgttgttacatggatacattgagcaatggtacagtctgggcttctagagaaccatcacttaactagtgtacattgtacccactaaataatttctcagccctcagccctcccactctcctactcttcccagtctccagtgattattagttcacactctatgtccatgtgtacacattagctcccacttttaagtgagatcaggcagtatctgactttctgtttctgagttgtttcacttaagataatgatctccagtttcatccatgttgctgcaaagaacatgatttcattgttttttatggttggatagtattccatggtgtgtgtgtatgtgtatgtgtgtgtgtgggtgtgtatataacattttcatatatatatgtgcatgtgtgtgtgtatatacatatatatgaaaatgttatacacacacacacacatattttatctaatcatctgttgatggacacttagactgataccgtatctttgctactgtgaacactgcagcaataaacataggaatataggtatctttgtgatataatgatttcctttgggtagatacccattagtgggattgctggatctatttttaagcaaacaagaaaaaaccttaaaatacctcttcctctacaaagcaaataaaaaatattcctgaccttggaggcagttgtgaacactagtggaatgtgtctattttctggctgagagaagcaaaaatcatgctggaagcagccttctgcaaaggcaatggttacatgggcaatagttacatgcagaacaagcgctggactggaagtggcagacctggggttcaattcttactatttcttagtagctgtataactctaggtcactttaactttctgtgtttcttctaacatgaaacagggataataacacttcacttcacttagcaacatacaggaaagtgcattctaaaatagaaatccttaaacatccaaataattttttttaccattagattaagaagaagcactgatatctattaatttttatttggctaatatctcttgccttgggcattttagatacaccaagtaatatgtttttgcagtgatttcaaaggattgtgagtatttaggttaaagtaaagtaataaagctcctgcttctttgagaaaaaccacatgggctttaaaaaataaaccgttgactgaatcttggtgctggtggggaagtgcctgatgtgtaagattcaaagctgtaggtaaaacaagtgatctgttttccctctagctcaacaaacacctgcgtgcctatatgtccaattacaacagtgatttaaatgtgtctaacgtattgaatattagtaagataactctaaataatttgctatttttcttaactaaagtaaacatttattgtaaagcatataaactcttttatatcaaatttactaacagaaatcatttcttcaattatttgaagaatgataaaacttaagcatatcatctcaatgttttagttttcattaattatatatgttgcattaaccatgccaactaattttattgatgttatttcatcttactatcctaaacactgaagtatactcatggctgtttttgaaccaaaaatctgatttattcgttaaacagtcattaaatcatagtgtacccaatttattttcaatttataatgaataaaaacaagctgtcatcttaagctattttcttgcagtattactaacatttttctgacatttactttttttcattgattttgttaaatatgacatactggctgttggttgctatttagcttcaacatgaacttcacatttctgacattcgataaaatcttaatatctgtataagttgattaaaaaaatgtaagcatgtatagtcctgccaaccctttaaagggccaattaatcatgatataattttaataaatctacccaccctggcaattattaatttattcatatatttaacaaatatttattggaaacaatcttgccaggaactgttcttagtgtctgggatacatggatgaacataacaaataaaataatccctgtcttcatggtcttacttaaaacaaatgaagaaactgaagcacagagtgaataaattactgaccaaaagcccacaactagtatagtgctgagtatttactccctgacttcatatcacaatatatccagttaatggtagagaggtgcttaaaatgcatgtctgtcaactcccagactagggatattcccacagttccacactgtccctctttctcttcctaccacaccacctcacacttgtttgtaatgatttctgaacagtaatttaacaattgctgcaattagacttttctacagtctgataaaaacaatatgatttttaccatttgcagtgatgatttcccttttggttcctttctagggaggaggctccatgatcttaccttcccaattatgaagtaagcaacgatgacctcttaaactcgtgaatctaacagtggttgggcatagataattgctgtgaaatacttgatgactgattagctttgataaagaattctgagataatttttatgctgttgttactaatcccaccctcagcattctttcaaaaatgagattatttgtctttttcttcatggccttggtggaaatataaatttctttttaaccctaaaattgtcttggacttataacttgagatatcctatgagaaacagattaattatgcctgctaattttggaacaaactatcagcctaataatgtctttctagttccatcttccatcatttgaaattccagtaaagtaatacttgttgagtactaacatttatatgtattttacgtcaatgatctgaacgtagctgcttttgggatatgtttgagaaaagttggagaaatgttacagcctaaagttgtattttgtttgttgtttgttttcaagtttcttaaaatgtggggccgggcgcagtggctcatgcctgtaatcctaacactttgggagactgaggtggttggatcacctgaggaaaggagttcgcaatcagcctggccaacatgatgaaactccgtctgtactaaaaaaatacaaaaacttagctgggcatggtggtgggagtctgtaatctcagctactcgggaggctgaggcaggagaattgcctaaacccaggaggcagaggttgcagtgaacggagattgcgctactgcactgcaacctgggaaacgagagcgaaactccatctcaaaaaaatgtggtccatctagaaaatttgcactgatattggttatgtctgcaataattcgctttcatttctttgcagcagttgttttctattgtttcccacaacaccaagtgaagagaatatagccacttttctgtagggtcaaaaaatattcaggctttccctcaaaaatacaaagttaagctcatttcttaatttccttcaggggttgtataaacagtcacttatagacacacacatgcacagagacacatacacatataaaatgcataagatgtacacatattataaatatttatacctatatacttcctatgtttataattctgtgtatcaaagaagagactttctgtgtgaaacatctataatgtaagaagggtagtctataatgaattctaaatgcattccactttgttacaagtacttataactttaagaaatattttaaaatgtttaataatcaatgtgatcaatattcccaattgttatcaatgtctatgataatgttttcattaaaagagtcaaaatgggctgggtgaaggggctcacgcctgtaatcccagcactttgggaggccgaggcgggcggatcacgaggtcaggagatcgagatcatcctggctaacacggtgaaactccgtctctactaaaaatacaaaaaattagccaggcatggtggtgggcgcctgtagtctcagctactcgggagactgaggcaggagaatggcatgaacctgggaggcggagcttgcagtgagccgagatcgtgccactgcattccaacctgggcaacaaagcgagactctgtctcaaaaaaaaaaaaaaaaagagtaaaaatgatagaattttctgctgttaaaacaaaatgatttgtgaacaaagctggtacagataaggtgctggataataacacatattataatacataagtcccttatagaaacaaaatagtaagtatgtacaaagccataaattaatcttaaataaacatcaatttccattccaatgcaagtaatacatctgatgtatgtttagcactgacaacatttcagtaaataatgaaatgctttagatctgaaaagaagagtttgccatagaagcattaacaaatttttatatctgttgacaaaaccttgctaaatttatgcacataaaaaaatagaagtaaccttttctgtgatcacataactgggggctggcattgcgagagaagagcctgctttaccagttacgacacagcagcatgcctctgacttaaagttcagtttttaaaaatatggatatgatcatagcaaataattccaggaaatatgtcataaattagcagacactgtaataaactgtctggactgttttgtctcagtcatgtcattttatcctatttagtttcaaaaatagtaatcagtctgttcaaagtgtcaactttagccactcaggatggggaaaacttgttttgacattatgccgtatgaaaaatgacaaaatgaatgggacaggctataagaagtagattgcaggctcaatattagtctactgtgtgcatgtctgtcaaaagaagctaataaaacataaggctgaagaactgaagtaatgaatgcaacaaagaatgtaataatcccattgttctctatgcaaatcggaccctatctgatatgtaatgctgatttctgagagtcacttttaaaaagaaacattgatgagttaaagtgctttcagaataaatactcccgaaagtttgtactaggaatgataaagaaatggaagacatttcttaagtaacatgggagagttagagaaatatttgtctttgaatattttaggcaatattatgtagcaaaaggattagatttattttgatttcctgaactagttagtacaaacacaaacatatactagttaccaccaatgggtaaagggccctgtaagatatacatatatatataaataaaaacaataactgacagggattgccaactctagtgaaaataatttctttacttttcactccacacacccttttcttcaagaaaccttgtgtacaacttataaagggagagtgcgaaaagtttcctcatcaatagagtttataaagaaagttttaaagggatcaaatagtttgggataaagaccttttcttgagaatactaaacatgctaatgaagataaaattcatagacagattttgccaagaagttatccatgtacttgcacaaaagttttattcaatatagttaacaagtaattagaaaagcactcttttttataaaactatgtaaaactgtaacttcaaacaacatacagctatatccaaactggcgaatgaatatgcttttgtctcatccaagaaatccaaggctcagtcctgacagtcaaacagggttaaataaaagacaagggcttgcaggcaggaacaaacagatgattctttccccaaaggaaacacacgtaagagcattaaatatcaagtgtgcctgcccggcatggtgtgtgtctgtagttcctggtactgaggaggtggaggggggaggatggcttaaccccaggagtctgaggctcaagcaatgcactatgattataggtgcactatgatccacctgtgagtagccactgcactccagcctgggcaacactgctaaactctgcctctactgaaaaaaaaaaaaaaaatcaagtgtggccctccaagcagggagaagcctttcagcagcagaggtataatgtcggctcttccttgaggtaaacaggcccagaaagtacaagccgaacacaggcagggtgggaaggtggaatgggaagacacagaagaaacaaaatacaatagagggaagggaaaccagttaatgcatcaaacgctttatcccatcaaaggcctatgaacaaggagctcttgagttcgagtaccaaggctaaaatggagtgtcaaagagcctgtgaggagacagttgtggtttctagttttagaaggtgtgtcacgggcaccactgtggcctttgatgtatggtagtagcagaattattacaggtgatgctgaagctggtactcctaagtttcacatacttagtcactaggaactgatgtcccacacacaggatcagctagtttgctcggctttcactatgttacaactaaggaggtggggtcagacccatggccttctggagtgccgccttcacaggtctcaggtgacaagctataggaagtggactgcaggctcaattggtctattgtatgcatggctatcaaaagaagctaataaaatattaggctgaagaactgaggtaatgaaggcaccaaggagagtaatagtcccattgtactctatgcaaattggaccctatctgatgtacaatgctgatttctgagagtcacttttcaaaagaaatattgatgagttaaagtgctttcgcaataaagcaaatgctcctgaaagcttgcactaggaaagataaagggaggatgttatttactttttgtaaaactatttttttttacaaaaataatgataaagtaataatttctactttttgtaaagccattatttttgccagagttggcaatccctatatatcctgttcatcatttggatatcagggacccaggcctataggtggaagatctggttgctaaaaagtagaatgaagggaaatcttattaatgctttttatgcaagtacacccagagaaaagttcactacaattattacaaaactgaagctaaaaggggaatggaaaactctcatgcccagagatatctttctatctagaatcccaaaatgagactcaaggagaaatgaactagttaaaaacaagtatctaaagtaagaagaggggcagaaaatggagctgaaaagaaaacaggatgttgtcagagtgcaaggaaaagaaaatttacctgaggagaatgttcaagaacatatagggcagatcagacagatttttaagggaaaagaaattatggatcttgataaaagaaaaacttcagccaaattcaatttaaagaagtttaattgagcaatgaacgactcatgaatcagacagtccccagaatcacagcagattcacagactccagggcagccacatagtggaagaagattatagacaaagggaaatgacatacagaaatcggcagtgaggtacagaaatagctggattggttacaggttgacgtttgccttatttgaacacagtttgaacacttagcagtccatgagtggttgaaacatggctactgggattggtcaagactgagctattgctacaggtgcaaactcctaagtcaggttttcaatcttgtcttgtctacctgttaacccaggttacagttcatccacaaggactcaaatatagaagtacagagtttttctcaggccatatttagtttgctttaataacctcctgatgacttttaaagtagcctggtcccggactgatagtaaaattaccccactcagagagagagaggaatgtggacaaaatttatttgaaaaacaaagtgtcactccggcaaactcagaacacaacagcttatgtctcttcctcagggacactgtcaaaggactgactctgggcaaaagtgttcacagatacaatgttgggatccagaagccaaaaaggaaggatgaagaaatgactgtgagcaaaacagtattatatggtagaggagagatgggccaaattaagcagcaggtaataaaatcaatcaaacaaacatgaaaccaaccaagcaaatccagctgagcctatttgaaaggaaacaacaccagaggcagacccctcactacaaggaaaactattccaaacaggaccgttctctgagcctagaatgttcaagatttggggtccctcagggcacaagcagtgaaaagcatcaacacatgactcatttcaagcacggaggatgacgctaatgctgagggtctgggaggaagccacccccaggacacaggacttttaggactccagaatttcagagcagaaggagtacagcagccgtttagcacaggattaaaagcgtcagagggtcttgctggggatggggaaatacagagagaagagcagagtttgggaatgacccttcagtcactcatttcagaaatatttagtgagagtcaggcagtgttcatgatggaactagttagtactgattgccaaggaacaagagaggcagaaacctctgccttatcaggactcacattctcaggaaggttacagaaaataagcaagacaaatgagggaaataattttgttagggaggatcttaaaagaaaaaagataaatagacaagaatatgaagtattggggttgagggctgaaatacagtggccagggaaagagaggactttttaacgataattgggggagtgaaccacatggatatttgggaatctatccccttcagactcaagagcaggacaaatttgaggccatgaagaggtgcctgttaaaagagcgggtacctctgcacctctgctattgctttaagaaaagcatgtcatgggtggctcattagtccatggagaatgaaaagcatatatagtagatctgatcacagctggtagtttggaaccaagccaagccgagaccagtctggtatagccagagcttagtcaacatataaacgtaagtctgagaataaatgatttgttatcaaaagcacaatgagataccatctcacatcagttaaaaagtcaggaaacaacagatgctggagaggatgtggagaaataggaacgcttttgtgtggtgattcctcaaggatctagaaccagaaataccatttgacccagcaatcccattactgagtatatacccaaaagattataaatcattctactataaagacacattcacacatatgtttattgcagcactatttacaatagcaaagacttggaaccaacccaaatgcccatcaatggataaaatgtggcacacatacaccatggaatactatgcagccataaaaaagaatgagttcatgtcctttgcagggacgtggatgaagctggaaaccatcattctcggcaaagtaaaacaggaacagaaaacgaaacaccacatgttctcactcataagtgggagttgaacaatgagaacagggaggggaagatcacataccagggcctgtcatggggtggagggcaaggggagggatagcattaggacaaatacctaatgcatgtggggcttaaaacctaggtgatgggttgatggatgcagcaaaccaccatggcacatgtatacctatgtaacaaacctgtacattctgcacatgtatcccagaacttaaagtataataataagaaaaattttaaaaaataaaataataaataattttaaaaagaaaaaaaaagagcgggtaccctgctaacaaaggcagaggagactgcctcagtatacatgtcaccttggggtactgagaagagagtgaacattttacaggcttgtgttaagaattaaggcaaagacagaaactgagtcaggtcaggagaataaaggtggcagcttgacaaattttttattattatactttaagttttagggtacatgtgcacattgtgcaggttagttacatatgtatacatgtgccatgctggtgcactgcacccactaactcgtcatctagcattaggtatatctcccaatgctatcttttgcaataaggcagatgaggtttcatttccactccacaagaaagtagcactaggcattggggattttctctaaggatatgggaggcatagtgtcacaattaatgttttaatggaaaaattctcccaaaggagtttcaattaacaagtcacagactccagaaacttggaaaggactgacgagtaccatgcaaaagccagaagcaagagaattttagcttttcctttatggctgttatatgttcgtttcttcaaagaactcaaaagctctacctggttccatgattgttatctgaagggcagctccagttaaaaatatgtattaattcaaatgtacatcagttttcctggatgactgctctaggccctgaggatttgcttgtgtttttgcaatttcatgggtgggtctggctgtgccatgttttcatgtgttgcacagctctcgcagggggaaaaaaggagaaagagggagacacttgaatgttttaggagttagaatcatttcaacgtggggcacactagaagacagcttaaaatcaatccgcttgctgctcggctcatcatctgcctccgactaagtggaaaaataaattgggagggcagaattttagtctttggtgtaattgggatttgattcgcataacaggttttcatttttaactttaatttctttgggggagataaaatgatgctagagggaggtctgtcttctaatctggggagttggatgtagaggctgggtattttggcctctgttctgtcatgtggcgcccattgtaaaacgtctcctgtcttactctattgtgtgaagtgtctggacaaatatgaaaatgaaaacggaataacagataaatcttcagcccagggcaggagtgttgttggagatgactgaaatactgccctgttctgacctatttcagagccttctgagggcaagctgctcactctcctaggaacaaagaaggactggctgaatgaagatggggccagatttttcttatgtgccattgttctttcttgtgtgtttgtctagggtggaagggagggttatggcagcattctgcgaagggtgaatcattctctacctacgtttgcagcagtaaccaggaagatgcatggaaaagtaagtgacagaatggaaaagcttgtgtggccagagatgagcatgtgttgggcagttttctattttctgaagaatgacaggagttatttgaaatcagaaaaataaaacatgatgaaagtgctgctgaaaatatggtcaaaatcacagattgttccatgaattctgactgtgtcaactcttccaacatccatgtgaatacccaaagtagccaaatttgattccgtaactgttaaaatgttcttcatggagattttcaatggaggtggtaggagggtagtaggagtggaggtatttccttcaacagattttaaaagaaagaaaactttttttcatgaaaaattaaacaaaaacttaattagaaagcaaaatgaggaaatgagtaaacctaattttaatgtttaaattttaaatttttaaggtggcaatgcatctgtcctagaattatgggtttaaatccctcttagtcattcctgaacttagaaacaattgtacttattttgaaacctagcttttgcataattataagagctctgtacagtaaatggtataaatcatttatgcacccaattacaacattcatgtattaagagaatttttctgtctcctttcaatttttatctttgagactcttcatcttttgaaaagcatattctggttttcttagtttgttcttatgtaacattctatgtaaaaaaggaaataatggcagaagttattttatagaagtgctactacatctggtaaattttgtatatttcatttcccctgcaagcttttcaaacacagtagcttgaactgctgttagaaatttactgtctctgtgcttgtcaccaggaagatgaatgtgaccatttcacatcttgcaaaaaatactttttatttgttagcatttatatactaggtattatgcatacggtttcaaaatcaatagaaaaagaatacgcatcaggagaaatacttagattatcaaaaacaactcaagtgagaatgcattctgcaggtgcaatttaaagaatatgggtgtaaaacagagaatggaacattctataaaactaatgttagttgagataatctgtaaaatctaactatcagcccttctttctcggttaccaggagacaatagctgtgtacacatatgtggcgatgaaaggtaacgtggactccacatggcaaggcaggcaactgctcttaagtgcacagatagaaggttcacggtcactgtcggggagaagttcagtctgtctcgagtcatcttttagaattcatcaaagacggacagtctagaactattttcagtttcccaatggtgaagatttaaattgttgattaaagtccaataacagtaaaacaagaaaaggccatatgcttgagctgtcaatgattactcagattttttggggttacagtttaaagtattttgatttaatatcaagttatgagtattgaaaagggagggaaaatgaaaattttctaaaaaacgtgaaaagaaaaaccaaacccacatgtggtctatctttttcacgctttcaatctgtaatgaacttctggccaccttgatgtgaagtgccctgtacggagtgctcagcgtgttttgatagttcttatttgtgtgaataagaaaatgagcatttgataacacaaactgaaatgcagttgaatattattaatctttttaaaaaacaaaagcatagtaaggggaggaataggaagaccttagaatctaggtttcattttcatacaaatatttcctgttagctcaaaatggtagatgttgaaaatagaaggaatctaattggaatatttatattatgggtgatggtatttatgatgacatctgggcttcctggtcttggcgcagttcaggcagataatataaatggaaactgtaatacagactgagtagatgtcaagactcattagaaaatgagtggaaggactttgtacaaataagtacagggctactggcatttctttggttttgtccagagaggggtaaccctgcgtcatcatggctcttcctgcttggttttatggtgttatgtatataggtgtggcctttatcacaaaacactattaaatattcattaagcatattgtttatagaactttccacaacaagacagtccagtgaaagctatctttcaaaattccaattgttaccaggtatgtcatgtatacatatatggcagtttcttaaataataaattttggattattttatacatacatacatacatacacacatttggattattttatacatacacacatatatttttaatatcatcagtaggtctcatttatgacaataaagtaggtacagttgtagctaccatgagaaataagatgctatataatactttatgtctcactattaatttatattgtgtttattgttaaaatttcagctggcaaaggaagcctatggtctactaaggtgccaatcctatacacacttataaatttaatgaatattgataatcataaatgtgagaaatagtacgaagcatcgatcttgaaggaagagcactagaaaagaaaaaatgtttgaattgcataaaaacaaagttagaaagggaaacggttttgtcaaatctgcctatagactagaagttgcaaatttgggttctacattagaattctctggggtactgttgacatttgttagattctcacatacacaccgtgaatcagtagatgcccaataactattttaactagaaatccagcaatctacagaaatcactgctagatgactttcatttaaaacattacaaatagatatttccaatctgtattctgccattaatgaactcaattgttcaaaattgaatagcataagcaatatggaattgccctaattaggcagcattagcaaccataaaaatggtccagagtaataaaaaatgaatctgtttacaaaaaaattccactttatcattgtttaatttttaaaataagcaaaatatagctatttttggaaaacagagataaaaacaaaaagcagatagaatcagccataatcaaaatgtcccatggttgccacagctaccaagtttttttttcatttgaaaatatgtatattttaaagtcagatcaccagattgtattttagcaaattttttatgtagtaaaatatgagcatttcctatgttgttggataatctcttacaacatcacattttaaaatttatctttgctcatattataatatactttactaatttttattatttcagaaattagaagaaaattatctattacaaagattgctctttaattatgtctttgaaataaataatttctacatctttaaagcaatatatttccaggaatgtggcttgaaggttaaatacatacacatacaaactaaaaattcttgcaactaaatattaggccagatagaatttcaagggtagtcttttctctcccctgggaaatagaaatcagacaggagaaacaagttagaaagttggtaagaaatgtgtgacatgggaccaaacaacttatcaaagaagctgaatacaaaatcagtatgtgattgatacctagcagatccctgtcccaatcttcctaggaactgccaacaacatgagtgagcagagaagatccattatagttctcttgaggatttctttataggtgataactttgaaaggttgacatttacttacctatttagctaaggctgtgattacaatacgcacagtgttccaaagaacacaaggaaacggagatgaaatcagtggaagttcaaggagctgtttaaggacaaaggtgattatgattctatgtctggaaatgaccacagaaatgtctaccttctctcatagagcaagaagatcgaagcaaatgaacaaaggtgggatccggttccaataatgaagaatgtgatgactacatgtataccattctggaacagagaaaagactgcctgcagcaatatctctaaaaactacctgtggcagactcagtggatggtcaagtttggctctgaaacaagtctcctcatttgtcagagaaaggacagagaagatccagtttatgtgattaattcaatgatattagtagagatcatagatacaatgatcaaaataagaacattgctttttgcaaaatcagattaaactgcactccaaaacaatactgaatcatgtaaaagcagaacttcctctcagagatttctgtatgcaaagacaaaacaattaggtcacaggataccatgttcttgagactgtatgtccttactaagtttcattttcattcagatatgtacaagaccatttggtatttgtaaagaggttatgtttatctgtgttttcctgaatatagaatgaatatctttatgacaaaaaactttagctcagaagaatctttatcgcatttaaaataattaacaactatagtgcataatgtataattcaagggttttctgtagcccatttcccatctaccctgtccctgtccccatactccttcctcacctccacccaacctccaccagagataattaagcttttaagaatgagattgatcacttaaaagtaatatatttttactttatttctttaatccatgtttagactttcctacctgccaaaactttgtatcttttaaacttggtattctacttctttctcccatctcaaactatacgtaaatcagtgtgttagaaattccagtgagtttaattgaacagaaagttggggtatcttgtatcccctccttttttttcttttgggacataacctttgtttcccacttgtgattccagaatctatcttggtatgattcaacaccttttatcagctgcttctaaacaactttcaccaccatattgcctcctcattcttccgaaaatacactattttctagtcaggccaaactatacattctttccagagctgaccacacttgttatgttatattcccagctaaatgccttctgtaacatttactacttatccttctggatacaaccccaatgtcaccacctccttgagagcacccctgattccacagggttgagagtcagggtggcctgggaagaccacacatgtcctctgccatcattcagaggtgggtataagtgaaatgggagagttccctggtccccctcacaggatgtgtgacaggggtatggctctcttcttggctgctatgagctcaaagcccttacaagaggtggagcatgcagatgagcaggtgcaggaaccagagcgagagcttttggggtcccgccccacagcagtgtctaggggtgagtttctgtgattcccaaaacccaagtgggcacatgttacagtgtgctcttctagtgttgctgtccaagtgttaactagcttagtggaccctctgcctttttgcaagggcagagggccaatgtgacagctttctgtattctgagctcttatccagcatccaggaagaatcaggtgacacagggacttgaaggatgaatgtgggggttttattgagtggtggaggtggaactcagcaggatagatgggaaactggacaggggatggagtgggaagatcatcttcccctggagcttggccatccactggctgattctctgaccatccccagctgaactcctcctaacagtccttctcttctttcctctgctgcattgttctgccatccagtttgctaatctccttgtttcctgtctcctcatctgctcctggagcctggggttcggagtttatacgggtacaggacagggtgtgtgtcaggtcaaaaggcagctttttgggcatgaaaacaggaatgcccgtcctgtatccaggctagagggtggggcttttgctggggaactgccctcttctacccagtatttccctgtctcctttctgcatcataaagatgtgtggtacccagttggtgcagacgcgaaattcatctgtttctttatgttttctccctttgctctaaaagggtccatatttgcctgcattctagtgctcaccacaccacattggggtatttggttatgtgtctggtttcttcagtagcctaatggtgttccctgtgcaagattcttagatgggcctcaataaaatggttgagttgcactgaattgtgtttctaaagtagatatcatgtcttatttccaccagggcacaatgtctagcacttagaagcttaaaaaaagattgttgagatactaaatgaatagattaaccaaaagtttaatttttctagcagtgttcatgggtgggaacaaagcagtaaaacaaacacatacaaaaataaatggaggtcaaggacctataatactaaatgagctagcaccatttcatctggctgtgctacttcctagctatgcaacctgagacaaatcacatatactctctgatcttctatttcattatctgtgaagtggacacaaaaataatacctacctcttagcactgtttataaaaccaaataaaagtaagtaaagtgcttagcagagtgtgtaaaacacaaatttgtgctcggtaagtgttagttattatcatcttattgtttcctgaaaggcctccagctatgcttgttaagaaaggcttttattaagtgtatttaaagatactaatgattaaagtaatgagagtcaacacagtcaatatttattgagtgcttactttgagccagtcatctattctcactggattacaccattgcaacatcaaggaaacagttttaaaaaagtataaccagcacaaggttagtaaggagaaagcatgaaaactgtgcttctcatttcatcatctgggatcttagcaaatatacaacattcaagcaaccttctatgaatctagccacacattatggccccaccaccctgcgtcttaattttgttagaacttgccttattataattaagcacgcagccttcctttaccttctagtaaacagtacattttctgaagaccgagactgtgtaactcacctttataactctcacagcctaaagctgatgtacacacaggtgcacacacacagaaacacatacacacacacaaataaagaggagaagtgacaaagtagatccacattgttggaaaagacacagcaggttaaaggagggccactctcagaaacattttagcaatgaacagaaaaactagaccactcaaatgaaccacgtgcttgcattcacagtgttatacctgtataatttgttgaatttctaaaatctgtaattcagttagttcatcctccttcaaccttgagtcattttatagtttaattccagttttccttctctcctaaatcctgttgtgaaaaccactttcagattggctgtcttgattaatagctctgtaacgtctacattctctggtggacaaaacattttttgttccaaagtaattctttacctctagatgctggcaatttcagcatcaaaagaataaataaccaactgaaactatattcctgaggccaggctattgccatcagaacccatattttcctgtcttctcccattacctgtgcactgaaagacagagcgggtggcatctgaccaagcagctctcctatgcctggaaaagtagccactttctgagcaggcaatggatggatttaaacttccaacatctttcatcaccaaatagcacttccccagaagtgatgcatcatctggagttatttttcgggtaatggcacttgaacctgaccggtacttcacctaaattaagagtggaacaggtctgtaaagaggacctatgactgttatgcatcccataataactataatttttgaacaccctttttatagtagatgctatagaaaatggtggataaattttgtttttatcttcaacaacagtataaggaagatatgccaattttataaatgaggcacctggggctcagagagatttaggtaaggattagcatcaaggtaagatgccaagaaggggcagagaagggagtcccataaaggtgaatctgaagacatcctctcttcccaccacaccgagccatgacctgtagaaaaccatcaatgtctggtggtgcctaagacgctccatgccatgggaaaaatttattgaaatataatatccacatggaaaaatcaacaaaactttatgcctaaaacttattcatgaagagacaatggtaaagatacttaattagaaatataaaatagctgacattgtaacatatcctctatacttattgttgggaaacaattgtccctggttattttattatccttggttattttcacatttcagtatgatcctgagcctctgagcaaagggtactgcaaggatgtttgcttaacagacagcctcggaagtcggagagtaatgtctccattaagatagacagcacgggagagatctggagacaaggctctctcctttctattctccggatgagattggcttacattctggtataacagataattaatttctcctctctctctctcaatctctctctctctctttctctatctatcactgttgctcttactcaggcaaggcagaggtgcgagtagcccatgaaagtttagtctctcctaatttgggggttcctctcccatgatgcaaacctaatgcaaacgcaggtaaacttttgactcttaacagcatcgccatgaaaggactgggaactagagccacaagccagagggaagacagttctctggctgctgcttttctgtgagtcataaggctctgtgtctctgccccggactctggtgtcttctgtcagtatatgcataaaactgtgcaaggctaacctgttagcttgcaagtagagttcagttatatgcgggcgattggctccatgaccctcacctataccaaaatccgtgcatacccaagtcccgcagtccgccttaaggaacctgaatatactaaaagtcagccctttctagatgcgaggtttgcatcccccgcgaatactgcattttcaatctgtgtttgcttgaaagaaaatttgcgtatacacaaatctgtgcaggtcaaacccatgttgttcaagggtcaactgtaatctgagaccctcctcagtttctaaattaacatcagaagttctcaaagtgtgttcccacatcagccctggggaatagttaaagaagcatatacaccatggaatactatgcagccataaaaaatgatgagttcatgtcctttgtagggacatggatgaaattggaaatcatcattctcagtaaactatcgcaagaacaaaaaaccaaacactgcatattgtcactcacaggtgggaactgaacgatgagatcacatggacacaggaaggggaatatcacactctggggactgttgtggggtggggggaaaggggagggaaagcatcgggagatatacctaatgctagatgacgagttagtgggtgcagcgcaccagcatggcacatgtatacatatgtaactaacctgcacaatgtgcacatgtaccctaaaatttaaataaataaaaaaaaaaaagcagcagcaaattcttggcctggcgcagtggctcacgcctgtaatcccagcactttgggaggccgaggtgggtggatcacgaggtcaagagatcgaaactatccgggccaacatggtgaaaccccgtctctactaaaaatacaaaaaattagccaagcgtggtggcaggcgcctgtagtcccagctactcaggaggctgaggcaggagaatggtgtgaacccgggaggcacagcttgcggtgagcccagatcacgccactgcagtctagcctgggcgacagagcgagactctgtctcaagacaaaaaaaaaaaaaaaaaaaaaaaaatagaagcaaattcttgggccccagcccagatccactgaatccgaagttctggggtggagctcagcaatttatgctttaataagccattcatgtaattccagtgcacaccaagatttacaaaccacaaaacatactctgttcatatgtttctagtaacagtagctccatttgacagtgccctgctaacacaaattcattttgaaagaacactcaacagatctatctctaaaagaattaagatttctttgaagaaatcactttcatgtgtttgatttttttaattcaaatatttaatagtagtacaaactctgcactcacaaccataatttagtgtaaattagaagagtttcctcaatttcaaatactatattacttggctgagccaaaaataatcatctgtacagagcatctatgaaaataaacagcccattttgtcacactgtcactaagtagaaatgtcttgctttttcaaattgtgcttacttgtcataaaaattactcagcaaatataaaagagagtgaaaaaattaaaagttattaatacatgttctgtattcctccctgcaagattttgtttaaaaaacacacacaaaaaaaacaaacaaaataccagaaggttaccttaggacaatatcaagtatcaggtcttaatggctgtaaaatattcccataaactataatttatttaggcaattcatcatctacagtatgatgtataaaagtgatgtttttaactatttatcacaataaaaagttacacggcactctaaggaatccctagaatcaaatcaattggaaaatcattaaaactaataagaaatctgtaaattcatactttcaaataatcgatagctttgctatgtaccagcaaaacctatttagaatatccaaaaaaaagcaatctcatctgtactaacaaattttatttctcatttgtgcgataaagctttgcccatatctttatttgcaaatagtgtgtcctttttatacaaaagcatatagagaaatacttgattcaatttaacagtgttgtcttttagcaaaggaatttaatccacaatgataatccatgacaataacaatatttaaacttattatttaccttatttaatgccatatgattgggttttaatacatattttgtcttattttgataaaatgatcgtgtttaaatgttttcctgccacttataaattatgcacacaaaacatattctactatggtttatctgtagatcgtaaaatgtttgaatctctagtaatatcacatgcaagacaaaatgttgagcaaattttactgatcgctttgccctaaaacctattcccaccctatgtacagatacacctacaaactcattctccaaacacaattacacgcctcttttgattttacaattaaaaaaactcttgcaatactctagaaatttttttatatttgttttaagccttacagccacactaacagcaataatagtttagacttgattctgagctctactggtattactgatcacccctctttctgcttttaaagtgtcttccctttctgagtctgtctagatggcacagtgtctttttcacgattttatgtgtacatggttatacactttgagttctcatatgttaaaacatttttctgtcattgcctccggaatgataggtttattactgacttgtaaggatttgttatatactcttgcacaccaagggctttctgccattctcttttaagaaagctttctcccctatttccaatgttagggttgttttgtcattgaattcttagatcaaaggttatctctcctttgcaaacaacccaatccaaaagtattcacttgacttctgatcattttatcctctttaattttttaattaaaatatttattataaattgacaaattatagttgtagatgtttatgggatacaaagttatattatggtatatgaatacaatgtggaataattaaatcagaccaattaacatatctatcaactcaaattcttatcatttttcatggtaagaacatttgaaattcacttccttagtgattttgaaatgtacaatacattatttttaattatattcacgatgctatgcaataaatctcaaaagaaaaacaacaactcatattcctcctatctaactgaggctttgtgccctttgaccaccatttccccattactccacctctcagcctctggtaaccatcattccactctctacttctgtaagttagattgtttcagattctacacaaagtgagaatgtgtagtatttgtcttcctgtttctgatttatttcatttaacttaatattctccagttctattcatgttgtcacaaacaattaaatttctttctttttaaaagtgcatagtactccattgcatgtgtttgtatatatatatcacaatttcatcatccattcatcggttggtggacacacaggttgattccataacttggctgttgtgaacaatgctgcagtgaacacggatatgcagatatgcagatatgcctttgacacgctgatttcaaatcttcagggtaaataccaaaaagtgggattgctggatcatataataattctatttttaaattttctgaggaacctacatctagtttggttagactaatttacttatcccactaacagtgtacaagggttcccttttctccacatccttgccaatgaccttttgtttttttgataatacccattttaacaggtgtgaggtaacaatcattgtggttttgatttcatttctctaatgattaatgaaattgaattttttttcatatatctgttggtcatttgcatgacttcttttgagaaatgtctattcaggtcccttgcctactttttaatcaggtcatttgttttcttgctattgaattgtttgagtttcttatatatattggatattaaccacttatcagatgtgtggcttacaaatatagtctcccaatctctaggatatctcctcagtctgtacattgtttcatttgttgtgcagaagctgtttagtttgatgcagtcccatttctctacttttttgcttttgttgcctgcatttttggagtcagataaaagaaaaatcacagttcagaccaaggttgtgtagtttttcccccgtattttcttctagtagttttacagtctggggtcttatgattaatcctttaatccatttcgagttgatttttgtatatgctgtgagataagggtccaatttcattgttctgcatgtggatatacagttttcctgacatcatttattgaagagactattcttttcccattgtatgttgttggcacctttgttgaaaatcaatgtacatacgtgagcttttttctgggcctctattctgttccattggtcaatgtgtgtatttttaaattttttttattttttataaagtacatttttttgacatgtacaacacaaagtttttaatgtattgacaatgtgtctatttttatgccagaaccatgcttttaaattagtatttgtagtataattttgaattaggtagtgtgatacatccagctttgttcttttggcttagaattgccttggcttatttgggaatttttgtggttccatatgagttttagaaacttttctaatttctatgaaaaatgacattgaaattttaatagagactgcactgaatctataggtcacattgggtagcatgaacattttaacaatattaattcttccaatacatgaacacagtctatctctccatttatttatgtcttcttcaatttctttccttaatattttagagtttccagtgtttatttcttttatttttttggttaactttattcctaagtattttaatttttgtagctattgtagatgggattctctgtgtaattttatttgtggcactttccttctactagtttatttccttccactaatacttaagctggaactttccctgttgactgctgggttcccagttcccagaatagtgactggcacatagaggccactaaaacaattgttgattaaatgaatgagtgaatgcatgaacgaaatcaattagtctgatatcgatagcttcattgagctctggaaaagaatgtgtggcttctgttaatttctttctatctgagccaaaagaagagaaaggtattattctattttttttttcattagcaaagttgggagaccaggttaatgtggagaaagaaaaaaaatgtaggcagaacatcacagctgcatataggcacctctgttcatgagggcagctgatctctcttgtgtgctgtagcaaccacagctgagagtggaacctggcaagaagcaacccccacaaacctccctctggtagtcaggctggcctctctcagagcagtgagggccctaggatgctagtccccaagaacagcagtgccatgtgagaagctacagcaccatcaaattttgattgtattgacaattcaaatttttttctccaaactggccaatgttaatttagaagaagtggcatagcaaggctgggactcctccctaactcatcatctcaatccttgcagggaatgaaccctggtgtggcacccacttcatttccttccataatctgaatgaacttcaattatgcaaagagtaatgttccctgatttctgtgcctactagagaaatggttcttaatattttagttgagtgtatctgaagtgtattagaagaaggagaaatgcaaatggccttagaataccttgttggtcctgaaaatcctagttcctttttaattctattcttggctggttgttagaactggttttgaaaagtgctcaagagaagatgacttaggataacattgacaaaaaaggaaaacccatgtgttattcctaagcaaaattataaatattttaactatttcccaattgaggacatatgctttcccctatcagacatacttgtggatgcatggtagcagttgttgatcttggcatgtacattttttagtctgaattcataaaactgtgcagaaatgaaaagttggttatgagaaggtcatgagaaattagtgtttagtgggtacagattttaagtggaggaagataaaaagttctggagattgatggtggtaatggttgtagaacaatgtgaatgtacttaatactatagaattgtacactttaagattgttaaatagtaaattttatgttatgtatactaaaccaaaataaaataaatggtgatcccagtgcttaccttgggtggggaaccctcaataattagaaacaattattcaaaaaattttcaaacacctatttgtgctttttcatattaatgtttgcagttgttagtattatacacataattcaattccacttgaaaaacaattgctagctgattctgtgaacacattttggaaagatataattagttaatgatgccttgtcactactgcagattttacacattgttaatattgcagaagcttctttaagaaaatgtattctaaagttactatcttagtatctaaaataatactaactaaaatatagtcattggccaggcgtggtggctcacgcctgtaatcccaacactttgggaggctgaggagggtggatcacctgaggtcaggagttcgagaccagcctggccaacatggtgaaacctcatctgtactaaaaatacaaaatttagctgggcgcggtggcgggcacctataatcccagctacttgggaggctgaggcaggagaatcgcttgaacccaggaggcggaggttgcagtgagctgagattgcaccactgcactccagcctgggtgacaagagcaaaactgtgtctcaaaaaaaaaaaaaagttgtcattgtgaactttgctaacattattcattaaaagtcattcctaacattgtatgttactctccttgcccactccttttagtcttgagactaataaatattaattcattcatggaataaattaaaacaatatttttgttcctatcatgtgccaggacctgtggtgaggacgcacaaaaaggaacagaccctgagttcaaaactcctatctgggtgtgcttatgcggtgaaggaagagtagggatgtgaaaggaaagggagacaaagcatgatgacaatgagaatgaacaataacatgaaaaaccagccgggcgtggtggctcacgcctgtaatctcagcactttgggaggcggaggcgggtggatcacctgaggttgggagtttaagaccagcttgaccaacgtggtgaaaccctgtctctactaaaaatacaaaattagctgggtgtggtggcacgcgcctgtagtcccagacactcgggaggctgaggcaggagaattgcttgaacctgggaggtggaggctgcagtgagccgagatcgtggcactgcactccagcctgggaaacaacagcaaaactccgtctcaaaaaaaaaaaaaaaaaggaaaaagaaaaagaaaaaccacaggtcatttagtccacgaagacacgacctttacatgcatgctgtctcagatgatccttccaacaattttctaagtaaagtactattgttatttcacctttacaaatgataaagtcatgctcagaaagtctattcaataccattctcaatatcagaaaattagtaatttgaggtacctgtctctggtcattttacttcaaagcctatgttttaaatcacattatgatattacctatcccttctaatgttaaaacaaaacaagcaaatctacacaaggtgagaaaagatagtgtggaacctgggaaaacagtacaacaaaatttggcatgattattattttttttttgtcagaggaattttaggttttagttttggggaagttatcgagtagaatgctatcagtctcattaatgaaacaactcccaaaacattacacacacacacacagacacacacaaatacacacacacacacacacacacacacacacacgggggagaggggggcggagagagagagagagagagagggagagaaattaaataacagcagataggtgatatctggaaaactggtggataacgaatgactgcttaaccagatcccaggaaggcaattgcctgagctctgaatgaagaaagcttactggtaagttgattcacatgtcagatcttctacattgctaggaaagttggctacaaaggggacacaagtagagggactgacagaaagcttatattagaagaaggaagacccatgctttactttgtcaaactatcatactgccgtccctccaaaaagtttaatatgatcatatcagaaggatatgagaataaaaaaagagaaagtaagagtgtgtgtgtgtgtgtgtgtgtgtgtgtgtgtgtgtgagagagagagagacagacagagaagaaaataaagaagaaaggagggaaaggggaaggagtgggagagggggttggaggaggagaggaaaacagaagccctggttatggtttaaactatttccttgtatagctttccaaaaattaaatctaattttagaaggtattataacttactattacattttataataagtttcccaaatgatacggaagttttagactactacttttagggattcagttaactgacattctcttctaaagcctctttgagggatgtggtgcctgtttcaaatgacatttgctaccttaaaacctaggactcgagttatctatccaaaggcaagttgagtaattttcacaagaatttattaagtctattaatcttgtttattccagtgaagcagatcatttatgttcttaggttataggtaaatggtataaaattcttcagagaatcaatgagcttttgttttgtttgtccttctcaatagcacgttaattttaactttaaaaggcatacaatttgatttcataattgaatcacaagaaacacaaataaaaactatcaaaagtttggtgctaataaataaatcacccaaattcatacctgggaaatttcagattttacacagtgaggctttctttgagcaccaaaatccctttagaatgtgttaatgtgctataggagagggcactgtgtgtatccaggttgtcctggaagaaatgcattcctaaagaccaacttaatccaatagaattgaaagtcttagcattgaatagtgaagagatgcatatttaagacattccagaaggttcttttcccttctgcttggatactcattgctaggtgacagactccttctcctctttcacgtcacctcaaccaaaaactctgttctaccagagcctctcaaatgccatctctggtttccacctttgaaatgcattgatttattcatttggtaaatattttttcacacacaaagttacacagccaccatctgtccaaatcgtgctaaatgccacacaatattctaggtgctttacataaattatttcatgtatatgcaacaatactccagtgtaatatgatctctttcaacagaggaagaaactaaggcttagagaaacagtgcaccagccacagaaatagaacacggcagagccaggcggcagggcctgcagtctctgcactctgccccgccagcactctgtccctcaggtagcaaacttgagggtttacttttttttttttttttttttttttgaggcagagtctttttctgtcacccaggctggagtgcagtggcatgatctcagctcactgcaacctccatctcctgggttcaagctattttcctgcctcagcctctcgagttgctggaattacaggcatgcgccaccacgcctggccaatttttgtatttttagtagagatggggtttcgctacattggccaggctggtctcaaactcctgacctcaggtgattcccctgcctcacctcccaaagtgctgggattacgggcatgagccaccgtgcccggccgagggtttgctttatacctgtccctgtactacacttcacacctgtcatcccatctgaatgttaccacaaactgatgagcaaggcactactgttgttcacttatgcacaagaggaaactgaggcttatagggactaagtcacttgaggaagactgcttgtctgataattggtgactgggtgacccaaagactctctcctgccctacagcgcaagtttctactcactgccctctgcctttgctctaccaaatatctgcaaccatgcagaggtactctataactgtactgatttctaccaggacttaataaacataaacttattttgagctacataaaaatatctaataaatatgataaatatgctagaatcatgaaacagtgatcaaaactactgtatctaatggctgctctttaaaataatctgtgtattacaagctgtaatagctccagtgacattttcaacttcatggaagataaatttaactagaaaactccaattatggaaagaattatttttgtaccatacgtataactttaaacatccaatttcattcagatataggaaaatcataaaacctttccatcagattaacaataaaaacacaaggactacccccaaacttacctgacaaagaattaaattaaaaggtttaaattggtacaaatagtagtaggtctatgattgagactcaagtaggaaaggggaagaaaaaccggaacaacttcaatttctatgtgaagagctggcggcaaatctaattaacaacacaaagcctcaggcgaagaagctgctattctaccctttgccaaataaaatgaacttcatcttttaaaagctccagccaagctaaaataagttactaaatggtaagacgtgtgaaatccaagccctttaaagatacagaggccagaacaacaaatgtaattgcttcattccttaacaagcggattgaaaagtaaacaccttgtggtcattataacaactaagtcatataaatatatttgatgcagtataaaataaaataacgcctatagaaatattccatacactgtaggcctctacagttatcgggtaagatgtaggtaggtaggtaagacatgacaacacacatggctttgctttcaactaagggcttggttacctgtacagtttctggtgatagcatccattgagaatacacactttgttcagcattgtgctttggggttcaaggataaatttacagtatcatacatgtacttcaggccttcaaaccgcttggggaaatggaaagagcgcacatagcaatagcactaaatatatggcggaagataagccagtgctgaattttgtgggtcaggtgagaaaagttttaaaatgctgagggaggtttcaaaagcaagagagtgcaagagaatttgcagagtttgcagatttgatgggatttagaacagtagaaggagggggcatggatgaggaggtcagctctggaaggctgagtcaggatgaactaagcactaagaagagcctctatcttccccgaaactttaatcacagaactgaaatacaaagagaaataaaaaatcgtttagcccattttttttcttccttagtccaatgcccactgtcagtggagaaggaaagatgctgtaattacaaaagccaaggaagcaacatgatgtcttagagaaaaagtgacagcttcggatttctaggaatgaggtcaaattctcactccagaagtttcctcccctagtgacctaggacaacttatttagcatttctaaacctcagttttcttatgtatcaaatgggggcattaatagtcaaagagtaaaaaaggctccacaggctttttgaaaatgaaattcagatgagataatgtttagcttctttctcttacaccatctcttctccacctctagagaagggcctgagtatccgctctgcttcagtgtgagtggcttcttggacactggtgatattatgaaataatttttcccactccaggctagacttgaggactaaatattgtgtgatctagccatatttttgtatctaattcaattgcaggagaaatgggaaagcttcaattaacacattttgttagaagacctaggctctgacctcacctaggagatacttctgtgaaggacttataccaggatttggttgggttagaatcgttcctgtgggaaatgagactcctcattcagaagatactttccagtttcttgggtgtgagtttttttttaattgcattagattacacattttctcctttttttgttgtttttactgttaacattagtcagcttgcatatgtgcatatgctcaacgcatgcgtgtgttgttttgaaacacaaaacaactggtgctttgaaaaagttaaacatctacaataaaattccaattgccatcttccccaggaagtttcccacttcattctttaaggtaagttcaatttccacttcttcaagaaggctgcaatcatccactgctttcctgatttactcctctcctcccgttaggttaggtactccttttatgtgatttcctacaaccttgaacacatctttagcactgtgctttatcatagtgtacaggtttacatacattttctgactccaggctgcgagttctttgggaacaagaaccctcttattcctcattgtatcctgtgtttagttgtctggcatataacgatgcactcagtaggtaagagcacaagatacttatctagaagcaacagaaatgtcaccctgtcccttcccatttaaatagtaaacattattctgtatgccaaaaggttcattcattcttgctttggtgcttcttcacatcattctcatatataagacacagcctccctagcccagttctttacatcatcttagcaattctctgattgtttagaaggccttacagaacaccgtaggtgccttacagaacaccttagtaattctctctgctgggtttgattctttcaaattcttagcccactaaatgcacttttactctatgcttgcatgtaaaggatgctgacttatttttcctttcaaagcctaggtctaaagagaaaacaactaaaaaaattctgcagcattatacaaagtaagcccaggtattagtcaaagtccaattccaacaccttaggcctacttgataagatgtgttctcccttagggcacaattcatctgtaatcactgctactggatactgacttgagcagaactataaacattttattgcagatagcttgactttgacaaaggcaaaatctttttaccctctaattcataagatctcctcatttactcatcagccttactttttaagagtgcccactgggataattacagtggttgtttcactcatgtcggctttatttagataataagctcaaaggccagggatgccttagcagtttctatctttagcactgaatacaatatatgagaataacatttgtgaaatgttaataccaggtttttaatatcttttagtaacaaatccttttgaattgtctaggggctacactggagtcaagtttcatttattttcttcttgagatttttatattgattccaatgctagaaattataggccattagtggatcattgagcatttcctcttcttgaacattttcagtagtgtactactgatacttaattctaaatttaatctagatatgtgctcctctagatccaatgccaactaaatatatatatgtattttgagacagaatctcgctctgtcgcccaggctggagtgcagtggcgcaatctcggctcactgcaacctccacctcccgggttcaagcaattctcctgtctcagcctcctgagtagctgggattacaggtgcccgccaccacgcccggctaatttttgtagttttagtagagacaaggtttcaccctgttggccaggctggtctcgaactcctgacctcaagtgatccgccagccttggcctcccaaagtgctgggattacagatgtgagccaccatgcctggctaatttttgtatttgtagtagagacaggatttcaccatgttggaaaggctgatttcaaactcctggcctcaagtgatctgcccaccttggccttccaaagtgctgggactacaggcatgagccactgtgcctggcccagtgccaataatttcatcaaaaattttctaagcgataattcagtaataagagtttgccacgtactgttctcagtgattatatacacacaaaaattgacaggtattttaaaacttattcagtgtctcacaaccaagaagcaatgcctacgatttatacacaggtttagaatttgaacatggtcttaccactacatcctacaccaagattatacaatactaactaaggtgatacagatggtccccaatttatgatggttccacttaaaaaatttttcaattttatgatgagtttatcagggcagaaccccaccataagtggaagagcatctgaactaacaataattcaacttataatttttgactttaagtttgtcagggtgtgaaatgtctttttgactgatatttttgacttacagtggtttactgggatgtgatcccaccgcaagatgaggggcatctgtacttcaatttggaaacactgacttgaatcataaaatttctgactaaaactattaaacataattgtagcattttatcattacatttatctgtcagttttattttaccatattttatttctaatattatatttactgaataattctatgatataatcgtttctgtgccaaagtacagaaataacagatttttgttattcctaagttttactagaatttaagtgactttaaaatataatcatagccttagaaaatttgtttagggaaaatgaaagtcatttattaactctctatggtaatattttagtgttagttgtgcaaacatgcgtgccaggacatgcacacacaaactcatttaagctttgcttttccatattgtgtcctcattttacttacttcttagccttattaagagtagcagaaagtgacctacattttcctctcctaaaaaattatgcttgtcatgttttctgcaagtcatattcagtcttccaacaaatgtttactgcttgcaatgtttatggtgcttggcatattatcagtaaacaaacagaaaaatgtcactgcacgaagcttgtatcagaagacagaccataaataatagaagcactaaataaggaattttatagtaggtgagaaggtgatatgtgctatggaataaagaaaaagtagatgtgggttgggtggatagagagacctgggtaatgggagtggagacagttgtatccttaaatagggtggtcctggttggtaccgttgagaaatggctacctgtttgaggagaagagaagaaagagatgcagttagccatgcagctacatgaggggagtgcaacctggtcagtcaagaatatttttattacttaaaactgcctttaaatgcttattcttgtgaatagggagaccaaaatgtgtgttagacgaaactctgacagttcattgagggtgaaaatgagctgtaaagggctagattgacaatgaacaaatgcaggacactcatcgtttctgccctgcaaataggctctggcttagcagcatttctgagataaaaaatgaaaattcccctggacatcctctgaacaaaaagagaaccttctgaaatgatggtatttactattgtaatacattgaaaaagaatagataacaagttgaacttcactacagattaggacctaaaaaatggctagttagcatgctgcagaagcaatgaataaataaattgttaacaaagaagtgactagaactgacccagatcagtgctcaacaagacttggatagataaagccgagactcttagctaaagtgcagcccaggggaaatgtctgcaggtcatatggagaactatccttctttgccatggggacaaggataagcacgggagtttcagaagcaaaaatcagagacctttgactgcaaatattgaagccccacaagagtggagagaggagaggcatctttgtgagctaaagaaagacccccttcctcatgcagatgtaaatgggacaaagccgagggacttgcatctaggaaaaaaacaatttggaagcccattttccaaatgattgacctttatctatattctgagcaacttggcagcacattgattcagaactgggtaagcagattctgaagtctaggaactttgactggaggacaccagctgctacttcttaatgccccatgatctgagaaaggaagtctgtaagtaaaaaccaagcaataactgctctgaagacccaataagattttatgaacctctgtaatttctctaatcacaaatttgtaatttttgttatttgtatttattccttgactcaaatattacttcctcaaagaagccttctcaaatcccctactatgtaaacttgcctggctttgcaatgtcagagggtttctacaacggtaattaaaataaaatgacaattatataatggaatatcatataattaattctataaagtgatttacagcatgtatctctctaaaatatgttttataaaaacggtaagaaccaggcttgttggccttactgttgtttccccaacacctaggccagtgcctaaaggagtcacacaataaacattcccctaaataatcagtgaagacatccagaaaacaagaccttcagagggattatgacataaaatgtactcagctattttcataggatggtacgttagggcgtggtgaagaataaaagaaaagtctaattggtagacaggcaggtgacaagaagagataagtgaaatacccagagcctacagatacagagaatatgtgctgacttcaataatgtaaagcactgttattgctcccaggtttaccgagggacaatatgagaaacatttatctaaagaatatctgtttttccccaaaattaaattttgggacttatgaaatttattacttagactatttaaaacattacctataacataggtattaacttataatttaagggaaggcttgtgagcatagaccctggagtcaaactgctagggtggcctcccagttctgtccctcactgggtgagtaagatgcttaacctcaatttcctcatctgccaaactgggatagcaactgcaaagtgagccctagggttgaaagaaggtgtttatacaatatatttaaagtgcttataacagtgcctagcctatggcaggtaggatgtaaattgattattattgttattactatctatacacttttgactgataatatggactatacaggctgcatgttattatctagatattttggaaagaattaaatgcttgcttgccacagcaaacatccctgggtacctggcaattccctttctcctgctaattagcttttgatttatattttaaccactctcaaattatattgacttatataactttcaaaactctaaattacctcaattgctttctagaagtagacaagtaaaaagttacaatcttttaagtattatacattgaatgcaatttattatgcttataattaccaaattcattacaattatcccttctaaattagtctgaaggtcaattaattttgaaatacagtgttttgcaaacttaaactaatgaaagctaattcagcccaggtatcagatattttaaagactggtaaaattacacaaacttttgaaatatacttcctaaatattcagattatttgcctctaacatttgcatgatacatcatagtaatttttttgactctgaagcagaaatgagtgaaaaagcacaatattcagcacatagtaagtgctcaaaaaatactgattgaatgaatggctgaactgatggttttcccatgagatggcctaaggagttcataggacggttgggttttatcactattaaaaatttatcaaaaactgtaccacaggttcttgctataaacacaaagaaaaacataaggtataaacacaaacagaactaagaatgaatttttttgtacaatctggtttcattgctatctatgccttctttaactactagttgaaaatatgatggactaaaagggaaaccagaagcctatttcttaagcccaactggatccatcataaaattcttccctaaacctctctcattaactttgagctgctaatgcctattgatccgtgtgttacatggcatcgtgtaggctgaaagtaataatgacagtaaccgcctattaactgtttaaactctatattgcatacgaaaacaccacaagttctggttgccatgcacagccgtacactatagaaaacaagtggctctacctcttactctccatcctgtagaaagtgctgtcacatgtttgatggggaagatgggaatcaggcagggtcgggtggcacagttgtagttagcaagcctgcttcaatgaaactgccactctgacacagtcttactcagagatatcccagaaaaccacggtcctctcctatggctccacgtgtgccctggagagacatgtaagagtagagggcaccccaagcacagaagacaacaatgatggaggcctctgagaacagtgttggcctctgtacagtttcctgccactctacattctctctgcatggttgcagccatatcctgactatgtgcagggaggatttaaggccgtcgaactgaacacttgacactttgttctcacactgtactgtgccccgatgtgattaaattagcaggatcaatctcttcctgagtccggttactgactgtatgccacaatttggccactagatttataattttttcccatgtccatatccctgctgagctctccagcttatttaggatagggacatcaatttgcggttgcccccgaccttgcaggaatttaggggtttcgttggctttttctaccagcagtccctcctctgcttctgtcctccttccctcatgacctacacccaggtctactggtgaggtccctgctggagataccctagacatgagataccaccagcagagatgtcactggcctattttgaaatcaggtcaggttttaatatttccacgcaaaatgtgaaaatgtaggggggaaaggagagcgctggatgccttcctatttcacatccatgttcacagtcctactgatgaccttagattcctcactgtatggttttaccacctgttgggacacctattcatgtagggccgtcacatccttgttactgacacattcaccggcttatttaattcttcatctattaccatctttttcaaatgatatgttctgctcactgagctggacttgtaacatgtttgctacgctagtaccacctgacaggtcatgacatagaaaaaaatcagatccatgataattttaaggtatcatgacatagaattacctttgaaattctattccatgtagtttcttgtacactgtcacaataaaggagtgtacttcttgctctattttctgtttctgaagttagcagtgaaaggattgaaggaaacatatgttttccagggctgtacagtcactctttcatgaataactgtttcactgaattcagatattaaaaagtttgcatactccctattcacccagaaacttgtttctatttaagtatctcttttgttttcctctcgaatctcaagtgcagatacaggatggggaagaaaggcatagagctgaagcataattggaacttgatccccaggatgatcaaacacaaaccttaacagctattgccattgggcagttatagaacaacaagtaaaatatataaaaagagctaaaagctttccttttctttctctctctttttgagacagaatctcactctgtcggccagaatgtgagtgcagtggtgtgatctcggctcactgcaacctccgcctcgtgggttcaaacgattctccggcctcagcctcctgagtagctgggattacaggcgcgtaccatcacgcccagataatttttgtattttaagaagagacagggtttcaccatgttggccaggccttctcagcctctcaaagtgctgggactacaggcatgagccaccatgcctggccataaaagctttccttttaaaagaaatatttcccagctatgagaaagtgatattaaaaaagaaagacataccataatacccaaatatggcaaatggctcaaatacttcccagaaaactttttatttccagcatcactaaaacattcctctgtggcttcaccattcatagcttgaaagaaaattcagtgcatttctattgcttgacacggcaaaatttacaaatacgtatagagaataagaattattaagatgtgagctgttaaaccatgaagctgccctgcttgaaaaacggtaggaaatctgaaagttgtaacatgatataaaaatcaaagaccaattcaagtgcaggctgaatctagaacaatgcattaagcctttgcttacaatgtggacctgcttggaattccttctaatgcatgaaagaacagatcggggcaagaattggtaggatatacacacaaaggcttttctggagtcgatgcaggagttccatcttgagaaaaagaaatcagggatagcaaggtctcctttatttatttttcagaaaatgtcattttctatttgcaacttcattaagaatgtgcatcatatgtcaccatatttcaataaaaaaactcagtgtactcatctgtttaaataagggcattacactgaaaataatcttttagatccaggtactgaagttgtcatatgtttatcattattaatatcaaaaacattttacagggcttctggttaagacaatgtagatgttttcatttaaagacacaaaatttcagttggataggaggaatatgttcaaaagatctattgtacaacaaggtgactatggttcataacaatgtattatatacctaaatgttgctatgagaatggattctaaaatgttttcataacacaaaaaattataacagtgtgaggtaacggatattttaattagtttgatttagccattccacaatgtatacatatatcaaagcatcatgtttcacaccataaataaatacaattgttatctgtgaggtaaaaaataaattagtttaaaaagatatatctatggcttttttaaaacaaaattcctagcatatacttgttttactaagagctacctctgtggtaacagtttaaaaatttataaatgtatcacctctggaacaaaagaacagtaacactatcttatgtagcccttcatgctttgatttttagcgattatattgtcctaaattattttcttctgtatatcctaatttaaacatttagtggatgtctaattatgctaaacaacatgagggctgaacaaaggagtactcagtctagtttggggaccaaacaaatacaactagtatatgagacaagctccattagggtcatattaataatcagaagggggatcctgggaggagaaattaactttaattcttgaagatgactattgtagaatgatatagaaaggtggagacattttaagtgggtccagaagattttcataaaaattgacaagaacagaggcagagaagtcggttgttgaaaaggctcaaatctacttactgtgcccaggattcagcatttcaagggacagtactaaagtgagaatgaaaaactagtaagagatgagactgattggcattttgtgtcattaaatccccatctggcttaggcaatagtcactgaaagtttctaaacaggaaaatcacatttgaattttgggaataggactcagcaatatttagaggaaattccagcctccctcattccttcatatacacatttgcctcttctctcctcaattctgaggcctctccaaccactcattctggggtctcagccctcccactctgggagggaaccccatccatcacttgtctcccctccattctccctccaaccttgtctttgctattataaccttcttgtgagaatttaataatccaatgttaattaaatttcagaagaatgccattcagaaaggtaatgagagcagagtagaaggtcctaggggcatttccccctaaacatcatgctttgaaaggaggcaattatgagaaagacagagtgagatactgtttaactgctcattctctgtttcttcctcccacgattttcacagctgcttgcgtcattttagctggtgggctaagggaagtgaccataacaactccaaatatggaaaaagatgcccatttgatgagttccctttttgtttctagatgcactcaagctgaacaggtaaattggagttactttttaaagttatttgaattaaatatatttattttttattagagctctataaatgatatattctgtcattgtctcatgagttataatctcttgttctctttaacacagccccacagtacactgtgactctcttcttagccaaagcagtagcaaaactgagtgggaggcaaatacagaaagccaacaggcaagatgtgaaacacggaactgtataatcaatgtgcctgagtcccctcattcactctcctgtaaacacaatcaaaagctctgattttaattcactcttgccctcatgcataaggaattaaagttgccctttccaagctttaaaacatctgtggtggaaaccctaattacaattttacacacacacacacacacacacacacacacacacacacacacacacaataccaatgcaaaaagaaaacccgtaagattaaaaaagaatacttcacaattctgagacgtttaatgaaaatgaaaaattaccaaaggccaatagtgccctagtatttattgtgtattgtggaatttaataaagcctttctgggcactgatattaaaataaccttcataacacttttaattccagaatttcaggatggaaaaatagacatttttgagtaaatatctctaagtgcaaatgaaaaatatttattaacttcgtcatcatttataaaagaaaaatattttgaaagtgctgttattaatcccctttttctcatctcttagtttgaggactctgcagtctcctgcagataacaaaaacatcattttccatatgcagactgagatgagagactcctggatattgtcagcacctaatgttcactgtaaatttataaatatgtaagattaatgctaacataaaatgagttagtggaaatgatttacacagaatcaatctgacttagccataaaacattaattacaagtattatgatacagcatcattattatttcacctgttactagattttatgatcatagtaaaagtactcaatcattgacaaagaatgtaactacagaaaatcactcaacagcttcaagtctgagcatgagggtagtttgtcatttattctctactacagtgaaaaacaccagagtggcttcacatagtactggaaagtttatctctagcaacttccaacttaaaagtagtccccaccccacagatcctattcacattaaaatccaactatacagacagcaatgatttccagaattcaagtatccatgcagatactgaaaacaggctttgaacactcctagaaaattcagagcagaccatctgaaacaaatactaaaccaattcggttaaataatacaaaataataagactttagaaatggctacaagaacttactatattttatcagttaagacatttcttgtttctaggtattatgtaacaaaatgaggcaggagaagtaaattaagcgtacaccttgaaacaatttttataaatattttctttttgcatgaggccagatgttgtctcaagcaaaaagaacaaagctggtggcatcctactacctgacttcaaaatatattacaggctgggtgagggtggttcacgcctgtaaactcagcagtttgggaggcctaggggggtggatcacatgaggtctcaggagttcgagaccagcctggtcaacgtggtgaaaccctgtctctactaaaaatacaaaatttatccaggtgtggtggggggaaccagtaatcccagctacatgggaggctgaggcatgagaatggcttgaacccgggaggctgaggttgcagtgaaccaagactatgccattgcactccagcctcggcaacagagcaaggctccatctcagaaaaaaagaaaaaaaaagaaagaaagaaaaagggaaaagcattacaaaactataataataaaaacagcatagtactggcataagaagagaaccatcaacaaagggagtggaataggagaggtcagaaataaactcacacatttacagttaattgctttccaacaaaggtgccaagaatacataatgaaaaaaggtcagtcttttcacttaatgatgttgggaacccaagtagatatccacatgcagaagaataaaactggattctttatcacaaaccatatataaaaataaactaaaatggattaaatacttaaacgtaagacctgaaattgtagaactgctagaagaaaacatagggggaaagctccacaacagtaatctgggcaattatttttggatatcactctctgaaagtacaagcaacaaaaataaaaatagacaaataggattgtatcaaagtaaaaagctactgcatagaggccagacgtggtggctcacgcgtgtaatcccagcactttgggaggccgaggcaggtggatcacgaggtcaggaaatcgagaccatcctggctaacatggtgaaactccgtctctacgaaaaaatacaaaaattagccaggcgttttggcgggcgcctgtagtcccagttactcaggaggctgagacaggagactggcatgaacccgggaggcggagattgcagtaagctgagtttgtgccactgcactccagcctgggcacagaaaaaaaaaaaaaaaaaaaaaaaaaggaaaaagctactgcatggagaaggaaacgagagactgcagaaacaactcagattgggagaaaatatttgcaaaccacacatctgatgaaaggtttatatccagaatacataaggaacttaatagcaagaaaacaaataatctgattaaaaagcgagcaaaggatttgaagggacaattatcaaaagaaaacattcctatagtaaatagatatgtgaagaaatgctcatcataactctcatcaggaagaggctaataaaactacagtgagatatcaccttatacttgtaaaaatgggtcttatctaaaagacaaaagataaatttgagaaataacatgaagaaaaggaaacccttgtacaccattagaataaaaattagcacagctattacagaaaccagtatggaggtttcttaaaagataaaaatagaattaacacataatccaacattcctacttctggctatatatataaaggaattgaaatcagtgtgctgaagaggcatttgtatccccatgttctttgcagcattgttcacaacagctaaggtagggaatcaggaatcaactttattgtccatgaacaaataaactaatagagaaaatgtggttcatggcacatactctgaaatcaaccatacaatctgatataaaacaggactcagcaaattaaaaaaacaaaacaaaacaaatcataccaaccacactttcggaccatggcaaaataaaaataaaaaccaatacttaaaaaatcactcaaaccataaaattacatggaaattaaacaagctgctcctgaatgacttttgggttaacaatgaaattaaggcaggaatcaagaaaatttttgaatctaatgaggaggaagatacaacataccagaatctctgggacacagctaaggcagtgttaacaacgaagtttatagcatctaacgttcacctcaaaaagtagacagatttgaaactaaccacctaacataacaactggaagaactagagaagcaagagcaaaccaaccccaaaggaagcagaagacaagaaatacaaaatcagagtgaaactgaaggaaattatgattgaaaaaccatacaaaagatcaatgaattcatgagttggttctttgaaaaaaattagtaagatagaccactaactacacatataaagaaaaaaaagataagatccaagtaaacacaattagaaatgacaaaaaagatgttaccactgaccgcacagaaatacaaccaacaatcagagactactataaacagctttatgcacagcaactagaaaatttagaagaaatcaataaattcttggacacatacaatctcgtatgactgaaccatgaaaaaattgaatccttgaatagaccaataatgaactctgaaattgaatcagtcataaaaagcctaccaaccaaaaaaaagcccaaggccagatggattcacagccaaattctgtcagatgtataaacaggagctggtgccattcccattaaaactattccaaaaaattgaggagcagggactcctccccaactcatcctatcaggccaatatcatccagataccaaaacctggcagagacacaacaacaacaaaaacacttcaggcaataaccttgatgaacataggtgcaaaaatcctcaacaaaatactaccaaatcaaatccagcagcacatcaaaaagctaattcccctgtaatcaagtaggctttacccctgggaagcaaggttggttcaacatacacaaatcaatgaatgtgattaatcacataaacaactaaaaacaaaaaccacatgattaccttaattgatgcagaaaagccttttgataaaattcaacatcctttcatattaaaaccatcaataaactaggcactgaaggaatatatttcaaaatattaagggccatctataacaaacccacagacaatatcatactgaatgggcaaaagctggaagctttctctttgaatattggcacaaggcaaggatcccctttcttactactcctattcaacatggtattggaagtcccgacaagcacagtcaggcaagagaaagaaaagaaatccaaataggaagagagaaagtcaaactatccctgtttgcagataacatgattctatatctagaaaaacccatagtcttggcccaaaagctccttgatctgatatacaactttagcaaagtttcaggaaactaaatcaatctataaaaatcactcgcattcctatacaccaacagccaagctgagagccaaatcaggaacacaatcccatttataattgtcacaaaatgaataaaatacctagtactacacctaaccatggaggtgaaagatctatacaatgataattataaaatactgctgaaagaaatcagagatgatacaaacaaatgaaaaaacatcccatgctaatggataggaagaatcaatatcatcaaaatggccatatggccaaaaacaatttgcagattcaatgctattcctatcaaactaccaatgacattcttcacacaactaaaaaaaaactatttaaaaattcatatgaaacaaacaaacaaaaagcccaaatagccaaggcaatcctaagcaaaataaacaaagctggaggtatcatattacccaacttcaaactatactatagggctagagtaaccaaaacagcatggtactcgtacaaaaatagacacatagaccaatggaatagaatggggagcacagaaagaatgccacacacctacaaatatctgatctttgacaaagctaacaaaaacaagcaatggggaaaagatcctccattcaaaaagtgttaggataactggctagccatatgcattagattgaaactgaacccctaccttacaccacatacaaaaataaatgcaagatggattaaagacttaaatgtaaaacctaaaactataaaaaccctggaagttaacctaggaaacaccattctaaacatagaacttggcaaagatttcatgatgaagatgacaaaagcaattgcaacaaaaacaaaaattgataaatgggatttaatcaaacaaaagagtttctacattacaaagaaactatcaacacagtaaacagacaatctacataatgggagaaaatatttgcaaactatggatcccacgaagatctaatatccagaatctataagaaaccaacaaatttgtaagcaaaaaacaagcaaaagtggacaaagaatatgaacaaacactttaaaaagacacacatgcagccaataaacatatgaaaaaatgctaacattgttaatcatcacacaagtgcaaatcaaaaccacgatgagatactgtctcacagatgtcagaatgtctattattaaaaagacaataaaagtaacagatcctggcaaggttgtcgagaaaaacgaacacttatacccaaggagtgtaaattagttcagtcattgtggaaagcagtgtggcatatcctgaaagaactgaacacagaattagcattcaacccagaaatcccattattggatatatacccaaaggaatgtaaactattctaccataaagacacatgcacgcatatgttcattgcagcaatattcacaatagcaaaggcacggaatcaaactaaatgcacatcaatagtagactggataaggaaaatgtggtacatacacaccatggaataatatgcagccataaaaaaagaatgagctcatgtcctttgcagcaacaaggacggtgctgcatttgtgggagaccattatcccaagcaaactaacatagggacagaaaaacaaatactgcatgttctcacttataaatggagctaaacaatgagaacacatcgttactaggaggagaacaacagacagtgggcctacttgagggtgaagcgtaggagaagggagagaatcagaaaaaacacctattgagtactatacctattacccagccgacaaaattatccatacaccaaacccctgcgatgtacagtttacctatatgacaaagctgcacatgtacccctggacctaaagtcacatttatagaaatacagagtagaatggtggtcatcaaaggcatgggggtgggaatgaaggaatgaaaaaaatgttaattaaagaatacaaatttacaaattttcgattagacatagaaataagtttttgagatgtactgcacagcatgttgaccataattaataataatgtattgtgtatttcccaactgctaacatggtagattttaaatgttctcattacaaagaaaagatagtatgtgaggtaatggatatgttaattagcttaatttaatcattacacaaggtacacatatatcaaaacatcacattacatcctgtacccctaaatatattgattatgtgccaattaaaataaaaatttaaatttaaaagaagtgattatacttgctcaatgtttttcacttaatgaaggtgtaagtaatcaagagcttttagattctagaatttaaaaaatcaattttagtagaattagaaattattcaatattgaagtataatggatcaagctttgaggtctctgtagaagatcaaatatttctgtatgaattatataaacttattcttctattgaaatgcatgttgcacacaataaaatttatcaattgtgcacatacatcttaatttgtaacatatactcttgtataatgggtacactccagatgtactcaggttttatactcagaatatagaatatttttgtgaaagctctcttgcatccattagtattcaatagtgtcaccccatttccagcttctgaaaaccattgttctgctttctgtcactacagtttttcttttctagaatttcacatcaatagaatcgtatgggatgcaatgtttgtgttttgctttgatgggaatcagtatataccatgccgacatgtgtcatattagcacaaaaattattttgagctgaagacatttgagttcctgaaatcccttatctgccttaaagcagagcctcctaatataatacgaaaagactgaattgtcataaatcccctaccccagagcaactaccatctcttatctattttcttaagagctcatttatctttccaaaataattttcttttccaaaagggccctttctttcctccccgcttcccctactaagttagacatttagaccccaaattcaatcacctattgagttactcatcactgagaactcccaagtatatgagcaacacatatgttaataaacctgtttttttcctcgctctctctctttaagctgtgttttgtcagtctaatttacaagggctcagccaatgaactaaagaaaaaagaaaattttttcgttccctacatctcttttcacttagtaaaatgattttgaaatgcatccatgttgttgtatgagtcaataatctgtcccttttcataatggatagtgttccattgtatctgtattccatgatttgcttgcctattcatcagttgatgggcacttagagttgtttccagtttttgactattataaacaaagcttgcaagaacatttgaaaacaagtctttgcataaacatatgttttcatttctcttggagagatacctagtagtgagattactgggccacacagggtctaccttccttattaagaaactgtaaaactattttccagtaagttgtaccattgtgcatttctaccagtaatgtacgtttccaattgctttgcatcctcactatcatttattattgccagaccttttcatcttagccaccccagtgagtgtgaagtagtgtctcattgtgatttccatttgcatttctctaattactaacgatgttgagcatctacttaggtacttatttggcattcatttaccttctcttgtgaagtctctcttcaaataaagtgcaagtatttttaataaaaatcaggttgccttattaagtcataagagttcttatatctactagatataaatttcttatcatatatgctctttaaatatattctcccagtctgtagctggtcttttaattttgtaagtagtatattgtgaagaacaaatattttaactttaaaatgtccaatgtaccaacattttcttttatgacttgtgctttttgcctcaccaaaactcacaaagatattatttttttcttctacattttatagttcactgctctctatatagtttatagctctataaaccagtttgaattgttttgtatgaaggatgtgaggtcgaggtttactttttccacaaggatttccaattgttccagcatcattttttgaaaaaacgaagatttctacattgaattaccctgggtcctttgttaaaagccaattaaccatattcctgaattttttattttttctaatgatctaatatgtattcttattgcaatatcacactatcttgactattttagcagtagagtatgacttgaaatcaaatattgtaagttctccagctttgttttctgtttaaaattttgtttaattactctgttttttgcagtctcatgtacttttcagaattaagtggtcaatctactataatgttttataggattctatattatttaattcactaggattacattgaaactatcgatcactttgaaaataatatctcaacacggttgagtcatctaatctgtgaaaagggaatatctctccgtcattgagttctttttaaatttcttggttatgttttcagtctatagattttgaaaacatgggttgcatttatttctgtttttaatgctttcatgctattataaattccattgttaaaatttcaatttttagttattggtgttagtatagagaaatgcaattaatgttcatgagagatattggtcttcagttttcttttgttataatgtctttggttttggtagcaggatattgcagaccccataaaacgaggtttggagaattacctcttctattttctggaagggttcctatggaattggaaatattttttgcctgagtgtttcatagaaatcatcagtgaagccacctgggtttgaatttttttttgatattttaaacaatagattaaaatgcttgatagacattgagcttttcaacatttaccactttcttcttgacagaactttgatagtttgtgtttttcaaaaacattttgcatttcatcttagttgtcaattttattggcttaaagatgctcactcatctttaccatcttttcatttctgtagaatctgtaatgatactcatataattttcttgatattattaatttgtattctctctttattttctgattggactggctaaggatttgtcaattttattaatgctttccaagaactgccttttgttttctttaaatttattttttactgttcttctgtttctatttaattacgtccttgacttatactcactatttccttttttctgtttgctttggttttaattttcttttcttgccatatagtctctttagacagaaacttagaccattgatttgatactttcttcttttctaatataagcaattagtgcaaaaatatttctctaattattgtttagctgttttttacccattttgttgcatggtaacttcattttcagtcagttcaaaatattttctaatttcttttgtgatttcttctttgaaatgtgggttatatacaaatgtgttcttttgtttttaaatagttgccaaatttcaagatactcttttgttattgatttatagtttaatttctttgtggtcagagattatacttcacatgatttcaatcctctttaattcattaagatttgtcttatggctcagcatctggtctcttctgggttatgttcttggtgtgtattttctgttgatgagagaaatattcaagcaaatcatgttagatgatagtttgttcaagtcttctatactctttccaattttctctacttgttctatcagttactgggagcagagtgttgaaatatctaactgtagttgtggacttgtctctttttctttgtagctctatcaagttttgcttcttatgatgtgaggctctgtcattaggtgcagaaacgtttaggactggaatgtcctcttaataaagtgatatctttattattacaaaatgtcccttttttccccagtaatattccttgtctaagatctacttcatttgacattaacaaagccatcctagctctcttttgattactgcttgtgtggcacaccaattttcatcttttcacttttaatgtcttgcttaaatgtatcacgggactgtgttttctccacccctccaccagtgcatcactcccattatcgagctctctataggtcagtgaatgggacacaagacagcgctcaggacagaaacttaggaaatgactccattcctcttttctcctacccatcaaggggatcctagtgattcttcagaaaacacaaaaaactcgtttacctgtctccacatccacagtacaaacctaaaagaggtcaagatcttcatgactctagagctcttgacctacctcctagctccctctgtaacccaccttcatgccatttcttgtaccagcagcaaggatgatcttaaatacatggcattatgaccctgctttaagtcccctggtcccttcccattgcacttcgaacaaaatgtaaattcctccccatgaccaagaagccctagatgactggcgccctgcttcctctgtaagcccatttctccttgtggaccaccacacttcggttcctcctggtctttcggcttcttgattctattaaattatttcttatctagagcctctgctattgcctctgcctggaataaattcacctgagtactttccattattagcatttaaactgagactgcaagcatgcgaaagtgttatcactttattcattcattctctcaacaaatatttgttcaatgcatacaagatgtcagacactaagcttcatgctgagaaggaaatggtgagcctaaagatatttggtccttgctctcaaggagcttacaattcaatggggaagacaggcatcactccaggaaagtgcaaatatgcactaaaagaagtcacataaagaaagtgagcccagctctatggaaaccaatgataaaatggaaatcaactgaggctgtaaataaggctttcttgaggatggattctttgaccatgattggaatggggagtaggagttaaccagcatactgtgaatccagtggtgaggaaaatcatattaatcgaaactttagttcatatacatgtacggttaacaagatacagtatgacaattttgatcagacaaatcatgattagtaattagttacaacatgctcaatgtggctcaatcttgtcatattatctgaaagtaaaattatggatttattatttcagtaaagaggaataatattttgcgtattattaggtagaaaagatttttttaaaagagtaataacaaggtttttttttaaaaagcaaactgattcctaactagtaaatttagtaaaataaaaacacatgttaatgatagtaaagattagcaaaaacaagaaatactttcatttccaaagctgcattccttaggcctcatccaaagatgccaaaacaattcaactcttcttttgatgtggacttaaaactagaggcagaatggaccaatacaaaaggcagagacatttgaatatttcacatttgtttctggggctgatacctcaaatggcctgggttggaggtaaagttagtcatctaatgtaccaaatggtgccatacttcacatcacttgacatattcctccaaattgacttcaaagtgtgattttacatttaagccccattttccttctgacctctcagctatgctgaaattaactaatgtcttatttacctatacatgttatttctgcctacctgtatttacccaaattctatttattttaaaaaatcgagtttaaaactaaactcttctccctcagttctcatctttataaaagtttctctgtcagcaagttctggtaatctaatcttggtgatatttagctacatattatcctgctttcctgtgtaactgtttcataggtgcgctacttgcatctctcaaatcagttaaccattgatgtttaataaatgactccaaaattcaatggctaaaaactatgaccatttacttagctcacgattctgctgagcagtttgtctggcctggttaggtactgctgatctcgctaggtcagcttatgcatttgaagtcagtttgagagtcagccaggggctgctcatcccagatggcctcacttacaggtttacggcagttggctgatgactgggtcacactgtgttcaagatctagcaggctagcctgtgcttcttcccatgggtactgggtactaaaagcatccagagggtaagctctactatacaagtgcttttcacgattctactcaaatcatttttacaactgtctcagtggccaaagcaacccacttttggataggaagacctataatgtcactatcaatagagagagagaaataattcgtggtcatttgttataatggaccatatctttagattaaaaaaaaaagaagcattttctttggaacccggtatcagtgccatgcatgtatgaaaggcgctcaagacattatatatatatataattttttttttttttgaaacagagtctcgctctgtcacctaggctggagtgcagtggtgtgatctcggctcactgcaaactccacctcccgggttcacaccattctcctgcctcagcctccccagtagctggaactacaggcgcccaccaccacgcccggctattttcagggtttcactgtgttatccaggatggtctctatctcctaacctcgtgatccgcccgccttggcctcccaaagtgccgggaccacaggcgtgagccaccgcgcccggccatatttttaactgaatgcttaactaaatgaacaggctgataaaagacccacacctcaggccaggtgcggtggctcacgcctgtaatcccagcactttgggaggctagggcaggtggatcacctgaggccaggagttcgagaccagcctgaccaacatggggaaatcctgtctctactaaaaacacaaaattagctgggggtggtggcacatgcctgtaatcccaggtacgtgggaagctgaggcaggagacttgcttgaacccgggaggcagaggttgtggtgagccgagatcgcgtcattgcactccagcccgggcaacaagattgaaactccatcaaacaaacaaacaaacaaacaaaaaaacaacgctcacctcagtctatttcatatgttagtctagtctctatgacaaagtaagtactttgttttttttgtggtaatactttagtgtcatttgcatatacattggtcaaaagaaatgggataactcaacttcttgattgggcaacatgaaatctgtaaattagcatgaatttccttcctggtactgcagaagttatctctgtattgccatagcaaactgaaatcctacagccctaatgatggctggaagattcctgacttcaatttgcaaaagtatttgtaaaaatgtcctagtctgagtttagggatgggtcatgtgtcttcagcaactacatgtcatgcaaatgaacttttgcattctactgagggatcaactgtacaggaacacaaaatgcaagagagaggagaggtttccgatcttcttagggcagggtgggaagaggtttgaaacaacagtggctgctaccacactaataccactcctcaacctcaaacctgcctccacctgcatctgttttaagaatgattttaaatagaagcaatatattcctttgagtttgactttatttaaattatggaaatcatgactctagtaaggcaccctaatggttcttcaagtctttggagaaaataaaaggtacagtgaagaaagccaagagaaatcctaacaagcttggtagtatttacatttggctttgaacaattgttaacactgaatgtgaatgtatacatcatttcatgcaatagctgtgttgtgacaataatactattaaaaacaaattcttggttcaagaatctctctttaagaattataggccaaatggctgcagaaagacacaataaggcagcgagcagttaattcatccaattaaaaaacagttgactgagcaataaacaattatcccaataggagcatatttcttatgggtgagaatgtccagaatagaaataaagacatttatgtggttggcatcaaagccatcccgaagaatgagcagaaacagtggactaaatgataaaagtgtagccaatcataaagctgttttttacctccctcccaccttccacagcatgatccactacacgagagaaaagacaaggatcattcctaggtcctctggaattaactcagtgccttgcacagtatcagtaataaaaattggtgaatacataatttaatagttcacaaagccaagaagcctcatcatactgcttaagtttgttttatcaggacttgaatttttaggttgaccggtcattgaaaatgcagattactttaactgcaatgggaagtcctgtggtttcacctggctctggaaaaggaaggaaacataagacagtactgtctggaggaaacaaggtcctctttcaaagcaaagtggctaactccagggcttcacatccaagcttatgcactaaacctgagaatgtaaaaaaagaaaaataaaattacatatgtcctgttttaagtcctcaggaatcaaatattctaaaatgtttggtgcaaaatgtgttttaaaggagcaatcagcaatgtcacagaattgaaagactgcgttagaaaaaaaagtgtgcactctactgggcttttgaaattgaaaattctatcagcaatttatcatattcaggtatttaaagtgtgcatatgaaatacatgccatgaattatttgtgacatttttatgatttagaaacacaagactattggttgatttccattgccatttggggcacaaattgatatatcaaaatacaagcttcagtttatcacacaagaagcagcaaaatgcactatcaatgccaatctgcctgttatcactattagcatactgcagtacgtctattacagtgcacgtgccgacaatgccctcctgacccacacaccattcataggtacttttgctgcccattggcacagaaaaagatacgtatgcaccatacaactccattcttccaactccaattctgcttattgggctataagtgaataattccaggttgaccaatcatattattcccagaaatctaatgtggtccatagaggtggactctgttagctctagacagctgatctggaaagtctgtagaaacaacactttgaggaccactgtgctgaccacatacaactgtggaagaagctggtctgaaggtagaaaaatatagacgagtgaatttgaagaaagaatgaaagagaggcaatgaggcccaaagatgctggcagctaaggagagtaacggctacttctaggccaggatgagctcctgtgacatacctacataatatactagtgtgtcctcccagtaaatacccttcaccaaagcttctgttccttctatcaaaatggtcctgtggcatctaatcttatctcatgtaaggggctgggtcagtggctaattcaaagcctaacatccactctactttaattaatagatggcattttactattaacagttgatatggacatgtatcgaacaaaggagcttcaatgaataaaacttttctagtttgttgtaggggcttatagaattgagtctctctcctattagagtgtaaactccttgaggataagatctaatctagtttatgttagcattacggtatctagaggcaggcggatcacgaggtcaggagatcgagaccatcctggctaacacagtgaaaccccgtctctactgaaaatacaaaaaaaaaaaaaaaaaaaattagccgggcgtggtggctggcgcctgtagttccagctactccggaggctgaggtaggagaatggcatgaacccaggaggtggagctagcagtgagccgagattgtgccactgcactccagcctgggcgacagagtgagactccatcttaaaaaaaagaaaaaagaaaaaaaaaaaaagagcaaaagtagtagtaggtcagttgatacattgataggccaatagttggcttttttttttttttttttgagatggggtctcactttgtcacccaagttggagtgcagtggcgcaatcttggttcactgtaacctctgcctcccaggttcaggtgatccccccacctcaacttccagagtagctgggactacaggtgcatgccaccacgcccggctaatttttcctactttttgtagcgacggggtcgccatgctgcttaggctggtctggaactgatctttaaatgattcacctgcctcagcctttcaaagtgctgggattacaggtgtgagccactgtgcccggcaaagagatggctttttaaaacaattatagttcatatccttaaaaagattgtaagaagaatttacaaatgtatgacattttagagagaaatattttagctctagtattctataaaaatcacacaaatctcctcaagagttgtgtgtcgggagccaattgtcaattccaacaaataagaaaaataattgaccagccgaaaccaaaaaaatacatagatacatatataaagtcatagttttctcataaacatcactgagaacattactggcagtattggaatatttgaatcaaaccgctacttttatactggagccattttagtttttttatttcatactttcatagctgaaatgaaatttcagctatttcagtgctgtattttacaatgttcttttcacagaagtctttgtcaggggtcattttttttccatattgtctcaacatttcccttcacttctgtttcgcttttaaaaaattatcagtggcatttgaaacaccacatattttaaaacagagtgaatcatagtttttatctctctgctgtatttaagataataatggatgttgagtagaaactaatcttaccactaattttagcatccattaaaaaattccaatcagtctcagtttgtagatctttgagtattttgtgaaactgtacatctattttccactgtcaaggcaatccattttcaaatcatgatcacaaataatttcttggaaagaaattacatttttactgttaaaggatttaaaagtttggccagacacagttttatcagctggaatgtaaaatccctaaaagtagaaaattgttgtcagttttgtttattgagatatttccaaaatccagaaaggtgctgagtacatagtacatgtccaataatacttctggagtaaataaatcaatcataccaagtgtcaatagttgggaaattttcaaaggccttttattatccttgtaacacaggtttgttaaatgaccctgggcatgtacctgattatattgatccttcaggcattcatttcctaaatgtgtactgagtgcctattatttatcaggaactgtggctcagagaaagtataccaagatgaatagattatagacagttctctctaggagttcacgatgaaaaggtaaatagaggagtgtacattctttgtatggcaagatgataaatacgacagacggtgaatgaataagacattaaataaatttacagcaaggagctgcttgtttctttatacatagattgagaagtataattgcagattccattatgcaaataaactatttcccctatgtgatcatctatgaataatttcataggtcaccaaggcactgatcaggacattaacagagtcatttattcaatgtaaatggcctattattatagcggaccttcaaaaatacgttatttgctcatatattaaaaatttccttgaaaataacttattatacaagtgctttccaatttatatagctctgagactgtgtccaactgatggggacaaaatagtcatttaacacaccgcagatcaatgatttcatttagaatatgtacgcggaaggttagttaagaactaaagggtcctgactttagactcacatgaaactgggttttgactccattcccatgaattattgactctttcagtctactgagttaagtcaggaccaagttttcatctatatgtacaaactttctgctggtgtcaaaaaatacagttcatcagaagaccaaacactgcatgttcttacttataagtgggagctgaacaacgagaacacatggacacagacaggggaataacacacactgttttgtgtgtgttgggaaggcagccagagggagagcatcaagacaaaaagttaatgcatgcgagtcttaatacctaggtaaggtgctgttctgtgctgcaaaccaccatgcacatgttttcctatgcaacaaacctgcacatcctgcacatgtatcctggaacttagaataaaataaaatagaattaaattaaatgtaaaaaatacagtctatacaaactgaggccacttatcaattatttgtattttctgatcacacaataatgagctcactccagtttccaattatattatgaaatattcataattttaattgacctcatcagaacccctaaaattatagattctattattccttacttaaaatttctctgaaaccaatgccaaggaactctgaatcttccagactcagttatccaagatggatttaatatttaacaaaaatacagcattgaatagcaatacttatcatttaccctgaatgtacaagtcctgccaatgaaaaagcacaaattcttgcacaaaaagtgaaagaagatatgctttgacataggatataacaaatacaatgtcaagtctactgaagatgtttaagtttggaattctttaaactacaagattttagacttatatatttaaacccttaactctcttataacaaagttttatgttacattggtcttctcttatcaatgggggatatcttccaagacccccagctgatgcctgaaaccacatatagtactaaaccctatatacacaatgtttttcctatgcatacatacttttagtaaagtttaatttataaaataggtacaataagatattaacaacaataactaataattattagttgaatattattaatgacatattataaaataagggttatatgaacacaagcactgtggtatcttgatagttggtctgataactgagatggctactgagggactaatgggtggggagtgtagaccctgtgaagatgctacatgtgaggatgattcacatcccagaaggacaaagcaggacagagtgaggtttcatcacattactcaaaacggcatgcaatttaaaacttagaatttatttctggaattttccatttcatattttcagactgcggtttaccatgggtaactgaaatcatggaaaatggaagcatggataaggggattgctgtacactcttagtaacagcaacattcacatgcattatttttatacagacttaaaattcaaaaacatttccacaaacactatctcatttaatgtccacaacagcccagtaaattgttgttattaagaaaaaaaaaacccaaaaaactatagttgaagagaccaagaaattgagttgcctaaaatcacagttagtaacttggttctctgcccttaagtccagcaccctttctctctcacaaacagatttagttttagggtgaatataagaatgtggaagatatttgtgcatccactttagtcttctttgcttgacaatcatccctgcttcaacatgatgaatgttcactttcaggtttggacacacctaagcagctctctctgaataaatctgccaagaaatacactaaaaatacttctattactaaataatagacttttacaaaaattatataaggaaaattcacgagaccataatctttgcaattatgtcatagaaagaaacttaaataagagattacatatgaaataatgctagttttgatattatttaagagttaaggagcccttaagtatctcacaaatgtaatctacttaatactagacctgagtgaaattccatagtctttcctctcaattcacactaagaactatgaatgacggctattttatctatctgctttaagaatagaggaatatatatatatataaaaagaaaaatgtgaagaagaggggaaagtagctactttcttatgaagcaaaaacaggattcagtagaaatattaggtactaattatacatcatgcactttagaaaacaaaaatcgcttatgtactaagaaatttttgtctctgaagccttcctaacacctcttaacaaattaataaaacaagacaattggattatcaatgaacaccatagtaatcaataccaaaatgactaggtaatgatctaatgaaaggacataatgtttcagtggaccttaaattttcattaaccactaatatcaataccaaatacttaatttcctccagaacagtggagaagtgatagaatatttcttcccaggacctaccctggggtacactaagagtatactcagacatttggggtttcttttatgtctcccgcttctacaaacctatccccaccctacacctgtcttttccaagaaacaagaaaagcagtccttacagactatcaagaagtaggaataatagtctagaatttttttaaaatagtatttggtatactggatactgcatattttttgtcagacatcaaacataagagggattcattttagctcttacttggaagaatgttttgttctcaaagagtctttgaaagaatagtgaagtgaaaagcatgataaaatgatgaaagatagctttgaaattaaactgatgtgaattaaactgatatctctctttctctctctctctctgcatctcttggtggcgtgactttgagcaaattactgaattccttgaatctcattttatccacaagtaaaaataaatagctgaacctgccacacaagatcatcttcagaatttctgagcggataaagtcctcggcatgcggtgaacactaaataaatgttccttcccttcccaaatccatagaattttaaaagacacaagattcaatacctggcaatattcaacagactcaaagtggtagtctcttctgacacccagtttggcagtagggtgtttctagaaatggtaaccctgggatcacctacaacagagcccctgaacttgattctgcttgcattttaatggtaggcgaggattttttatattagatgttacttgtatttttgaactataaaatattatacttatgaatataaatagaatatgttaaatggataaacactcccaaatatcttacattttaaaaattggaaaggaaatatcttgcactactaagactaaatggttttaaaactctgctttcttttaaataagagccatttctaactttgatcaaatggcctaatgttacctcattgcccactttgaaagaccatatggtgcatttacttgtaaatgctttgatgaaataatttaattacatcattctttccaagaatctggcttaggctgagattacacaaagagggaaattagctctattgaaaatgtatttgttttggttttggttaatactacatttgccacaaatctgcagatgtatgttgaaagatttgacatatcattcttatacctgcttgcttacacaattaagttattttaaaagacactggaaataaaccccccaaaatgaagaatatttaatagacagaaaatctttacaaattttttgatttaattgtttacaacaattcatagagaacattattaacaaccctagtaaatagctttgcataaacaatatcagatctgaatatgagagatgaagccaaaatttttggctttataaagctcacggattatttcagattcaggattgtactgggataaatataatctaaatcatagttgaacactaagtttggattatggggccgggcgcggtggctcatgcctgtaatgccagcactttgggaggccgaggcaggcggatcacgaggtcaggaggtcgagaccatcctgtctaacatggtgaaactccgtctctactaaaaatacaaaaaattagccgggcgtggtggcaggcgcctgtagtcccagctactcgggaggctgaggcaggagaatggcgtgaacccaggaggcagagcttgcagtgagctgagatcgtgccactgcactccagcctgggcgacagagcaacactccttctcaaaaaaaaaaaaaaaaagtttagattatggaactaggttctaagcatgcagaaccatggagataagcctgagtacaaatccagacaagttatacagagtgagttgtggatagtggtagtatcctgattacttaatatttattttataaagtttaagatttattaggttgggtcagcagtttaaagttataaataagggtaaaacagccaaactctgatattaagaatcatcaaagtataaagtttggcatatggtgagcactaaatcaatgttactttcctttctaaattaaaatgttacctcccttttcaggaggggaacatcacacactggtgcctgttggggggtcgggggctaggggagggatagcattaggagaaatacctaatgtagatgacgggttgatgggtacagcaaaccaccatggcacatgtatacctatgtaacaaacctgcacgttctgcacatgtatcccagaacttaaagtataataaatttttttaagttacttccctttataaattaagatttattttaaattaaaatggaagttgtataatctcctccggaaaggatcaagtctgggaagtttataaaagaacttgtccttggagataatttagtaacctcatgacatgagatttgtgcttaagctaaataaactgtattacaagggtacaaaatgatgatgatgaattgtggtttcaaaagtgaaaaggtgtcctgagattttgaatgtatgaatattttatttaaaattctataaagtgtcccgtttcaaattccacaatttaaagacagacaacatcagcaatcataccagaggtagttaagaatgcatttaagaagaataattataatgatgacagtagtgataatgttagtagtagctaacatgtattgggtactttttgtcatgcactatgcgttatattatttaatctccacaatgattctgacagatactctattgttcccattttaaagatgaggagattgagaaaagttaggtaatttgaccaatatcgcgatgctagaaagtggcagatttgagatgataaaatttaaaatatcaactactttcagaaatataacatgccagacttaaagacaaaaaaatccactcttgaaaataatagtaatgtcatctcaactataatttgctatgtgagattaacgaaaattcaacatagtagaagagtttacagatgagaaacttatgtcctcatagagaaaacagagaaaagtattacggtcaaggtcactggtgaggctacaaagcttttaaaatatttgtacaatcacttaacataaaatagctatttactgaacacacattatgtgccaggtctggaattaagcactctttaaattagacttctaattttcccaactaccccaagagtcatggccaaaaggtggcagagtcaggattcagaccagagaaaccaatctgtcctcagagcccatgttctcagccatcgtgttatgacccggggcatttatacaccttcaatcttcccagttttcatttaccaagccttgttcactaggacatttttgagatacctttttcctacacaggacataaaacactgcaaaagttgttacacattttagataaatgtgcatttcaagagacctagtcctccatgttaatattcaatatctctctgatttatgtctcagagatactgactcattcttgaatctcagggctttgagatgcagtataacctgtgtgcttgagagggcaaacctttggatgacctttatttctcaacatccgtccacccaagataagtccgtgtcatggcccaagcgccaatttacatcccttagcttctgctctcatagaagtcactggaatgcacttctaagacaaagtcttcttagtctcatggctccccttttttttaatctctcccaaggattccctacactaactattcctattctgccgttccattcaactctattgtcttttctcagctccaattctgttttgataataatcctgactagagtaaaactggcaatgtaatatcttggaacagaagacttttaagtttgaggaaaagatacatggaagtaaacttatatgcactagcagtacatgtaagggaaccccacagttagggaaggatttgcatatagatactcacaataggcacacttcatcataaccagttgaaaggagttagcatctccattttataggtattggttttacgtggcagaaacaacacaaattgtggcaattataggtttcacacaactatatttcagttatacccaaaaataagaatgcttgtcatgaaattccacttgcactaaatgttagctccttctacttcacataagtatgaaaaatatcttcaaatacatcagcatatgcttagctaatcttaaacacctcaatcgatgttcaatgcctttttgtgctagcctactttttcccttctgctatgtgtctagttagttaatatagctttccaatttacaagaaagcagaaatatttcagatcaggtcacgacatcaaatatcacctgcaaacagtaaatatagttttcaaactcttacacagtgttagtgagacaagtgaagtctgctttgcaacacctccactgatctgggattatatctaagcaaagtggatgcatgctgatcctttcaagaaggtgtcccggggaagatctaagtagtaatcacttgaagggactcaagagcaccactcacgatgtgctgaaatgcagaaggggacaaagaaggaaggcaagtctgttaatggagcttcatgattacttttgcaatgttactcatacatgttaaaccttatgaatagcagtcttaatcttttaacttacagttcagagccaggctagcttagtcatcaagagtatgaactttatttgtcaattaaaataagtaaaaaaaaggacatcagatttttttttaaagagcatgagctccaagtcagatggatggaattcatgtcaaaatttggacctatcgtatttaagggcaagctatgcacatcctctgcagaagactgtgaaaaaaagaaataaggtattactaccaaaatgcttctaacaatgctcaataaagagtagttattttatccctaactcagaaagatagagagagggcccatttatggagtacacaatattaagcactgagttggtgttttccagaaattatctcacttaatcttcagatgagatgttatcatttcagttttacaaattaggaaactgataatcggggaattagatatttgctgaagtcagacaacaaggaaacagtggatttggaacttaagacacatctgtctgatcttctggcctttttcacatttgaggagaatatagtaaagtttagagtcagttggctaattttcacaaaaccatcgtttgtgatacaatagcattgcattatttctgtatatcatttaagtgcttttgtcaggagaaatgaaagaattaaaataaaatacatttctagctaaataaataattgcatataggaggaaataataaagattaaagtaaaaattaatgctcagagaatcagaaaacagtaactctataaataaataccctcagtttttaaaaactctaacaaaataaacaaaccattggtaaccttgatcagaaaacaaaaggcagaaggtaaaactatacaaaatgagaaataacatgaagaattagctattgaaaaaaagataaaatgaaataagtagcataagtaactacagacatctatgtatacaagtttgaaaatttagataaaagacacagttttccagagaatcacgtgtactaaaattgactccattaatggagaaagtttaaagagatcaatttccatacaagaaatagagaacattattaaggatgaatatcataaaaaacaaccaggcccagatagtgtcatggtaaaaatctacaaaacatttgaagatcaaataatctcagtactctacaaattgctgcaaaacgttggaaatgaaagagacaatgtttccttttactgagccagaataacgttgatacctaaacctaaaaaactttgttcaaaagaaaataaatctatagacctatattgtccatgaatatcaatgcaaaagtactaaaataaatgttggcatgcatagtattatatatcatattaagaaaataatgaatacaactaagtgggatttattatagaaattcaaggttggttcctactaggaaatctattatgatcatatgcaatatgatttttccatatatgctgaaaggccttaatgaaattcaacattcactcattataagaatattcaagaaattgaatgtgatttttaacatattaaaaatatatatttgtcaatgctaaaattggtattttaattggacaacactagaagcattcctattcacatcaggaacaaggggaagatgctagttatctccattactatctattattttactgaaagtgttaaaaaaatgcaattagacaaaacaaatctattaaaggtattagaattggtagagaagaggtaaaagtatccctacttatagatgatatgatacctgaaaaacacttaagaatcaataataattaatgttaattcccaaatcgtaaaataatttagtaaggcaacaggatatgaaattaatattcataaattaagatattaatccttcatgtacattgcattataaataaataaccacagtgaaggggatgggaaagaatagaactaagctaaataacttttagaaaacagtgttttgaccgcttactccaagcccaaagacaaggaaaagtatccatacatattgtctgattaaaggtttgtttttcagagtggtatgaaattgcgactgtgagactacattgtgtgtatatgaagattaagcaaataattaaataaattgatgatgctgagagtgaagtttctcaatgttaaaaagaggatactgagagtgaagtttctcaatgttaaaaagaggagttacaagtaatggaagggatttggctagaatgaaccctgtgatgctggactggaatcaggtgcctcaggatgaactcaggaatgtgtgtgtgtgtgtgtgtgtgtgtgtgtgtgtgtgtgtgtgtacaaactgacataaagtagagatgtgtgcgcatatgtggatgtatatgtacacatatttcctagctctgtcaggtgacctagaagcaatggcagaagagcaatgagcacatctagcactcagattttgtttccaaatacctttcgctaagaaaaagagccaaataaccttcacagaaaggttgattttgggaatgggtagatattagcgggatgaagaaatggagcaagatgagcccgcaagatcttgtagtgccacagtgagcatgtgctcaaaatttcgtggcatcagagtcaccctgaaggagcccccaatggccaattctagaatgagagcaacaaactaaatgatgataataatgaagtttatctcatggaataaaataaagaaccttgagtccataccaccaataagtaattgaattaataggtaaggacaaaatccttagaatgaaattcaaattcaaaatacaaaaggaatgatggatatagaaaatcatcatctcacaaacacagtggtaagaatcattgatggaagctaaaatttgtgggcaaaagtttatgagaaaacaggacattggcatagtctcaaactctttcaccataagatccttattagctacaagggaaaaatataaatttatagtggagaaaactgacagactccacctcagtcaagtgatcaaaattaacatcaccaggaatgagacgtgttgacatcatgtaactcctcatatgacacactgagaaagtcacagtgtagcctctgcagtattcgtgcaaaaatttttaaaacctgaatttaatcatgaacaaacatcagacaaaccagaattgaaggacattctccaaaacgactggccagcactcttcaaagttgtcaaagtcataaaagattgggaaagtctaagaagtaccccaaatcaaaagagagtaaagagacataacaagtaaatgcagtcggtgatcctggattggatcttaatacagaaaaatgacatttgtggcacaaactcataggaacagagggtagaatggtggctacaaggatctggggaataggagaacggggagatgttagtcaaagggtaaaggtaaaagaataaaagtgaaaaaaaactatggtatatttacaaagtttactgttctgcatcagcaaagcagatcaaactgttgttataaattatacaacatggatcagccccacagagatgatatggaggaagaaaatcaaaatagggcatagtgtgtcattccatttatacgaaattaaaaaaaccgataacatgaattggtagtgaaaaaatgtattctaatgagtacttctgggggtgttaatcaggacaagtaacagaaaggcctttgggtggatgataatgcactgtatctttctatttgtgaggcttacacgtgttatttatggattaaataacactcaccaagctgtacacttaagatccaggtactttatcataggtaggttttaattagtggagaattatgcaaaaacatttattgaatgtattcttttgtctcagttttcatagtttaaacgtgccattttatcagacagaactttctaaaggatgcaattaaaaccaagtattaacttctgagattgcacttcttcataaaacaacagaagagaagcagaattgttttcttcttcaatgcctctgctgaacatgtatgcttcagatatctgttggtcactttcgatgatgagaaaataaaatatcctggtttttgctataaatgctaattattccatctgttcaaagcgtttatttcttctttaaaaatggagggaaatattagttatcggatacaatgaagttcagcactttgagatatcttagcaaaatatttttaacatatgtgtaccaaaaccgattgtttttaaagaaaaaaacaaattttaaatgagatattatattttcctaaactatcaaaatgtctctagctatatgaaggtgctaatgcaaagcaatgcatttcaattttcctcaacactaaaagtaaatataattttctcttaattataaaatttccagaatttttcatctgtagtaactccaaattagccagtgagaatatgttccagttagctagaaaatttacttatttatgactcttccgttcaccaatattgccaagtaaagtcatttacagatctgggaacaaagctggggtgctacagtaggacaatttggataatcatatttcccctagaactttaatagaatttcataacatacatatattttttgtccattatattgtagaggtcttcttttgacttttattctattctattcatacaataaagttttccaggtcctcggaatttaactctttcttctgccattaccaatttttcaaatagtaggtttgatctaattaccaaaacattattagaatctaggtagaggcatgttattattttactagctaatgatctccaggagactttggaattaatatagaccactctgcagaaataatgaccactgaaatgagggccccagcacacactgaaatagccacactcaaagaagattcatttctttaggagtttagtgaaaatggagagattgactaaagtaatctccagaaagcataaagattaaattggctcctaactgagaaaatgctaccttagcactcacccagttctgcctttatgattctttgacactgatgtaagcaccacagaaaggaatatcaaggtggaattacataatcctttcttcaaccaattgttagcgtgtttgctgtagattaaaacactgccacaggcttctagtggttggcaactcacactgtggaaaatgtcactgggctttgctgcctcactagctgtgctccacagagcagaaaattaagcgcaacatatttggaagaggagttttctggtttgtaagaatttataaaaatagctatacttatctattctagggtcatatttgtaagttattagtagctctgagataaataatttaaatttttagtacatatgctaaaatcttagattattctgactcgaaatctagctaagggtctcttaggtgacttaatttctgtttctaatttaaaagatacatacatacatgggacaataaaatatttttgaatccatggcacgtgaaaatagactgcaaaaaatcagtatctaaaaccatgcatttctgcttcagtttcttctgattcctgtccaacatagataaatctgagtagctagtcagttatcagttatcaaagtatgagtttcatcatgaatagcttagatttgttgtacaaatgtggtgctgcaaattgaatcattaatcaaagacatactaggctcaaatttattttattctatacattttgtttgcactatgctaagatttaaaattaataaccttgctctagtaagaagattgtttaggtatatttcaaacactcaaatgtgtttttttctttctgttaaaagcaacacgtagtttttccataaaaatcctacctcacggattgccttatcacacttaatttacaaatctggaataaaaccatgaggtgcaacagaataagatcatcatggaagaaaaatattcacagtactatttctagaaaagctcgcataaactttcgaaatggcatcaagccacctgtttgaatcactcagaggcatttgccaactttaccaaaacaaggacacacctttctgtctcctgccagttttctttcttcccttactttgttgtctcatgcaacctaaaatagaagcatcatatcaggcttctagattctgtctgcagtatgataggtcaatttcattatagatgctgagaactccagcctttagagaaaaatgctctcaaatctctccctctcctcagcactttgcccctcatatgtttgtaggtggcactctcatcaatactgctttctctaaccatggcttggtaaggcaactctctgccttcttaatgtcctatcgatcaagctaatgacatttacttagcacctactcaatgaaagtcactgttctgcttgttgtgggggatacaggtatacataggacatgaagtggctttctgtaaacaaagataaatgtcctctttatttgtttgtcatataaagtagcccctaatgcctgaatttccttcatcttctagcagtcaaacaatctctcacccacttacccacacttgacaacttgtcttttccataacgtttctgtttgaattaagaaaagctaacatttccccacccaggacaaccacaatgcagaattctgtactcactcttgccttatgcccttaaaacacacactcacgaccagtatttcatggcaatgtctcagtctttacgcttatttgacttaatgcttctctaccaatgattttctgtatgtgaatccccgttacttttgtaaatgtgggaggaggaactgcttgtaacttgtggagcactgagcacgtttaagcactggagccctcggtgagtatgacaatcatccacctggattacagatggtcctcactcccgaaaagtcttctgggcagaactgcatggcaaaaggctgtagtcaagtacagttatcatctgcaagaaagcccgcatttgggcaacaaccctggctcagcaaactcttctatttaaaaagatctaccgtaagtcaggaatttgtagcatttaaaatacaagccctcacacaccaaagattttctgtcttcaactgttcactctgccttcagaacacttggctgtttatctcctcctttgttttgctttgttttatcttgttcttcctttctctctaggtcccaggggataaactggctcagtaaaggcttcccactgagcacggggctgcgagtcacaattccttgatgatcacccaccccaagctgacatgtttcaaatgacctgaagtagctacatctgttcagtcaagttattacaaggaccttcgaaagtgagccgcattctgagcaaacaaccaaaagacgggctccttcccattcccaggagattgcaacctccgtgtgattggcagttttacggtctggctttctccatcacaggataatttcctcctcattgtaaaaagctttctgcagccttctgctttttggctcttttttataatgagcaaatttggcttagagaaaacttttcagactgagaaggaaaaggattttacgtcttaaaaccgtgaaactagtgtaagatatttaaaatgttatatttaaatatatatgatatataacatacacacgatatataaacatataatttatgtatatattaatatatgtttaaatatatatttttcctccactctgtttttcaaggggtttcttaatcctgaagtttagtgttgggctaatcagttatatcaacttttaggcactttgaaatcactgtcgctctgaaaaatcaatagccaaacaaacataagaactcaaatttataatgcctaagttgctgtgagctactgtaaatttaaccgtagaagctgagtaggttttgtgggtaaacgtgtacaactgagatgaatgagactttcagactgaggcaaaacagcagtgtgaactggctgttgttaccgccatcgacaggtaaggagtctctgtgactcgcacatagttgctgctgttggggctcgttactttgaactgcaggaccctgaaggggcctcaaaagcaaagcctctttctggccttctgcccttctttctcctactctcctttctcccacaaggcagatgatagaaactagggtttctcttccccaaggtgagtcacagaaaccagaacccctctcctccaaagccagtcataaaacctagaacgattactctaaccttcctccaccttgctgtgtggaagatggtcatagagaaatctgacctatctccttccagaaggtccctgcccaaacccaggaagacggaatgccacacagagggaccagaagaatctggacacgccctagttttattacccttagatgaatatctttttgtccgatcacatttctacacagctgtacattcttcattgaacctaagcataaaaacagacagctttccttaagtctttgcctcttcattttctgaaggctcccatgtcacgcaaacctttgattaaatgaatttgcaatgcttttctcttgttaacctgccttttgttataggggtgtcagctgtgaccctcatgatagggaggaaaggtatcacatcttttttgcccctacactgctcctcatcttcatgggtcaagatgatctccacacatccatatctaaggcacacaatacccatccttgtatatacatgtctcaacagccactcattattgttaaatatgggctggatttttaacaatattcaagctacctaagaagaaactagaggtacaggcagcctcctggctttttctgcaattactctcaccaaaaaaaaaaaaaaaaaaaaaaaaaaaaaaaaaaaaatcctctctacacacacatcagaatggctaaaacaaaagataatgacaacacaaaatgctcgccaggatgcagagactctgggtcattcacacattgctagcgaaaatgtaaaattgtacagccgctctgggaaacagtttggcagtgtcttttaaaactaaacatactcttgacatataactcagcaatgacactcttaggcatttgtcccagggaaatgaaaatttatgtgcacccaagaatctgtacacaaatgttcatggcagctttactcataatagccaaaaactggaaccagtccaggtgtccctgaacaggtccatccataccatggactactacctagccataaaagggagctgttgatacacacaacagcttgaatgaatctcaaggcaattatactgtgtgttaaaagtcagcccttcaaaggttacatatggtgtgattccatttatgtaatattattggaataacaaaattatagagatggagaagagattagtgggtaccaggggataggaataaaggatgtgtggctttaaaggaatagaataagggtgccacatagttacggaaggttctggatcttgattatgctggtggttacacagatctacatacgtgataaaattaaatggaacacacactgtctcacacacactcacataaacagaagtgcatatgtaattggtgaaattgtagtgacttctgtagatggtgcccacatccatttcctggttgtgatattgtactatagttacacaagttatcttcggagaaaactgggttaaagttacatgggacaatccgggatcttttttttttttttttttgcaatttttttgtgaatctataatttcaaaataagaagtataaaaatgaaaaagagaaatcttctcttgagtctcccatactagactagctgctgctctctgcttcctcttctgcttttttaatagaaaacttctcaaaatttatctacttgttgcctttaatacctctcctatgctatcttgcatctgctccaatcatagctctgattctttcaccagctcccaggaaactgcccttgtcaagatcaccaatgacatctatgttcctgtctaggggtcagctattcatctccattgcacatctgtcactccaggcccaataccgccttgacagcaggaagtgcaccgtagtcagttggactctgtcttcaggaggactttgtcttcacttcatggactctcccgattttttttttcctgatgagtggctccttcttggtctcatttggaggttcttctctttttcccagagacccattcccttggtaaactcatcccgacccctaggctgaaatagttacctatacactgacaactccctattttatacctctagtccagtctcttccctgaatcttagacttgtatctaacagccactgcaaatctctacatagattaccagtaggcaccttaaaatttacatgaccaaaactgagctccagataccccaccaaacctgcccatccccgttttttcctatgtcaacaatggacaattttatatttctagcaacacaagtcaaaaatattggtgtcatgaatttctcctctcatgcatcatgtccaatccatcagaaaatcctgttggctctactttcaaaatacatcctgaatccgaggatttcccgccacctttactgttatcatcctattcttgcccactattatctcttgactggattcttgaaatagttttctatgttgctactctgccctcactccctacatgcctgttccgtgcagtaaactaagtgctcctcctaaatcacaagttagagcatgacattcctctgcccaaaaagaccctatatattttgttgtttgttacttttccgacctcttcccttcctattatcacctttgtttgctctgctctagtccactggcccccttggtctttctaggacgtgccacatacatgtcacaggaccttagcctttgttgttcctccagcatgggtagccacaaggataacactcccccttcaccattcaggtgcccacatgacacctttatagatgaattcttatctttccacgccttgctgttctccaaaggactcatcatctgtctgtctgtctctctctctctctgtgtatatacgtgtgcgtgtgtgtgtgtgtgtgtgtgtacgatataccatttctttctttgttctttctctttgtttttttccttttttttttttttttttgacaggctcactctgtggcccaggctagagtgcagtagcaccatctcggctcactgcaacctccacctcctgggttcaagtgattctcctgtctcagcctcccaagcagctgggatgataggtgtgtgccaccacgcctggctaatttttgtatttttagtagagatggggtttcaccattttaattaggctggtctctaactcctgacctcaaatgatccacccgcctcggcctcccaccatttctttctttgttatctgtggattcctacacaaatgtaaacttcaaaggacaggatttttgtctgttttttcacttctgtattctcagtgtctaaatcttgcctggaacacagaagataagtcaatatataatcgtggcctgaatgaattatttaaccaattatgcaagtaattttctatttccaaataagagaagagttggtgtagctggagtagcctacctcctgagaattctgaaaaaccagagtagctcatctgctccactgactgacatctctggcaacagcagctgacaccgtctcactgctgcaaggtcagctagtcagtgggcccagtgcttcgcagcgcctctccactgattaacaaacaggcccctttggagggcagggcctatgtaccaccttagtcctagggattccacagccctatggcagtgagaaatgcagctggcaggaaggtagttacctgtgctcctcactgcttctcaacgcagaaaatctgaaatttgagccccagtgtaatcagcactgtgagtttgtagattataaatatttacatctgtgcttgcccaaggctggagcttataactcaagctttgcctgttggaaggatcagatggagtaacagagagcataaaccgttcactcaacaaatctttacaaaaggcctactggaagaagtccctgttctagacactggagataaagcagggaacaaaacagccaataatcgtgattccatgaagtcgatatttgagagttggaaggaagcaaataatatacatgcaaacaaacagataaacaatacaatttcagataatgattagttcagtgaatctaataaaataagatgataaatgactgaaagatttctttgaaattgggtgatcatgttattacgctgtggtgacatttgagcacaaatgtgaataatgaaaaataattagtcctgagggcagaatggtccttaaagaaggaaaagaaagttaaaaggcctttagggactaatgtggcatactggagaaacaaagaaagaaggccagtgtgtgtgccgcttagggagtgagaggaagttagaaaagatgaagatggagaagtagacaatcccagtgacctcaagtaaggagttcatgctttactccaaatgcaaaggcattagagatataactgcagactactcactctccattgttttcttcatgtgaagggaaacctagggcctccctcttgttctcgtgcctttgattggtgagtttagtaggaagaactgggcatgaaaggctcagtcccttcctcttgcctgcagagagcagggctcctgtctgctttgggcctagggctgagctttgtggccacagcttacctctgtagcacctgctgtgcaggtattcggtgctgcctgtggcttctgggtcagttcatctaattctggtgcagcagcaggaagcccaggctggcactcactctgccacattctccaagagctctgttagtaatagacctgacagtccgttctccatgtgtttaactcttttgtctccttctactgctttaaaatgctggcggggatgagggagttataattaacagccttccctctcaaactcctaaaggaagcttggatgtttttcttttctgaacaagaaatacagtgatctaatttatgttttaaaaagatgactctagcttttatttagggactgaattacagacagagggaaatgaaaagcaaagatattagtgaggagtgatggggttcaggacatgctaccgtaaaatatggcacctcggtatttgaaaacaatgcagaagtgggatgatctctctgacttctccttccttctcctctgaaccagttcataaaacctagaaataattttctgatcttccgctggagtagatcataagaccctcatgtgagaggtgcccttcctggaggaaaggaacgtctttatcgctgaagatacagggacatggagaagaatccaaacaaacaggccttgtacattcccttcattagatcataccccctttttccagtcatacttcttcacaacgatacacctcttcatcaaacttacaagtacacaggttttcctgtttctttaaatattcatttctgaaggctcccgtgtcacataaaacttatattaaataaatatgtatgcttttctcttgctaatgtcttctgttataaagacctcagccatggacctagcaattggtggggaaaagataaagcaggagaatccctctgcacgagactactatagttatttaggatagatacgatggtgccttggactaggattgataatggcaggcagagagagaagggtaaagaattggaatatacattcaagcaggccctggaagcaggccctgttctagacactggagataaagtagggaagaaaatagtcagtaatcttgattccatatagtctgtatttgaaagttggagggaagcaaacaatatacatgcaaacaaacaggtcaactgaagggatttataaacctgaggtaaggatcataaaaaattagtatcaaatatgacttctaggttctgtcttgagtagctgtaggtaatgaatagtgacttatccaagtgtggttctcaggtaaagagttgtgtagacaattatggagcttagtagagaggtctggaaaaataatatgaatttgggaattttcagatggtgtttaaatccactgggcaccatggaattacttagaggaagaatatagacagaaaaaagaggatggctgaggatagagctccaagaagtgtgctaaagtttaattttgtggcattagacagggtggaatggaatatgtgtacttgggagcaaattaaaatagaaaattataaaacaggaattaatgtatttcattttatagggttacattagaaaaaggacaaaagtgagacaaagcaaaaggagtgtctagaacagacttacacagcagaagctaagtaagtaggatgtgagaggaaatggagatagaagagaaatgcgaatcaaaaggtggaactcacgaaagtgaaagtgaagactttcatcttcagtggagttatgcaaatgaaatattttcacacacataaataatgataaacatagataaataaagcaagtttggagaggctggtgagaaaagtgaagtctataattcagtgttatgaatacagcactgtgtagtcaaaaggatttgctgtagggagtgaaaaggaacagagaatgttgatggaatgaaaagagaatcaaaaaagtgtgtttaggccaggtgcagtggctcaagcctgtaatcccagaactttgggaggctgaggcaggtggatcacctaaggtcaggagttcgagaccagcctagccaacatggcaaaaccctgtctctactaaaaacacaaaaaattagccaggcatggtggcgggcacctgtaatctcagctactcaggaggccgaagcaggagaatcacttgaacccaacaggcagccattgcacttcagcctgggcaacaagagtaagattctacgtcaaaaaaaaaaagtgtgtttatacttacctattagttatgaaaagagtcaaaagatgagacaaagataaatctaaaccttatctatagatacattctttgtagaagaaatcaacagaaattatagtttttctgtcaagattttggaagaaactttctgaagaaaatttcagaagagggcttcagggagtgtctaagaaattaatatcttaataataatgtttctatgaaataacataatatattttattgatatgtgcaaataattttacttcaaaaaattatctcttttgaagtaaaacacattgcgcagaaaataataattttcaagaaatcctgaatagccaaaacagtacctaaaaagaagaaaaatatggagaactcatatttcctgatttcaacactgtaaagctacagtaatcaaaacattgtggtactggcataaagacagaatacaggccaatggaacagaatagacagttcagaaataaatctttacattaatggtcaaatgatttttgacaagggtgccaagaccattcagtgaaaactggactgtcttttaaacaaatgcttctgggaaaaatggatttccacaaacaagaaaatgaaagtgtaccctcacctaatgctacatataaaaattaattcaaaatggatcaaagatgtaaatgtaagatctaaaattataaacccttaacgataaaacaaaagcttcgaaacacttaatttggcaactatttttttgattaacacaaaaggcacaggcaacaaaaaataattttatcaatttttaaaaaactgtgtgtcaaaagacagtaacagcagagaaaaaaatggccacacacaaaacaggagaaaagatttacaaatcatatatttgataagggattaatatccaaaatgaatagagaactcctaaaattcaacagctaaaaaccagaagacctaatttaaaagtatgcaaaggacttagatagacatttctccaaggaagatatacgcatggccaaaaggcacatgaaaagatggtcaacatcactaatcagtagggaaatgaaaatcaaaattagagtgagataccatctcacacctattgggatggctactataaaataacataaaataacaagtgttggtgaggatgtagagaaactggaacacttgtacactgttggtgggaatgtaaaatgttacagccactataaaaagtagtatggtagttcctcaaaatattaaaaatagaattcctttatgatccagcaagtcaacctctgggcatatactcaaaagaattgaaagcagagtcttgaagtgatatttgtacaccagtgttcacagcagaattattcacaatagctaaaatgtggaagcgaaccaagtgtccatcgatggaggaatggataaacaaactgtgggatagacatatgatggaatattattcagccttaaaaagaaataaaattctgacaacatgaatggaccttgaggatattacactaagtgaaataagccagtcacaaacaagacaaatgctgtatgattccattaatgtgatgtacttagcgtattcaaaatcacagagacagaaagtagaatggtggagtccaggggctgggaagatgtgggaaatggaaagttactgtttaatgggtacagagtttcagttttgcaagatgaaaaaagccctggagatggacggtggtgatggttgcatgacaatatgaatgtactcaacaccattgaactgtaaatggtaaaaacgtttaagatagtaaattatatgttacgtacattttaccataatgaaaaacactggatgaaaatgttcaaaaataacaatttcaggactctgaaaaatcaaacaaagacatacaagcaactgaaaggcatttaatcaagagaaaatactgaactttggctaagaacagcaggagtctctgacaagccattaaaaacagcagtttcactgctggagggccaacttgacttggagaggagcaaggaaaaccccaatccccttggcattactggaagcaatgtcgatggcaaacaaaccagaaaagccaacatcacagctaacctgcgtttgcaactctagttggagcaagcaacagacttggcatactgacctaagatttacagggagatccagtaaatgaaatggccatagtggccttgataagctccccaatattccttgtggagataaaaaatgtaaatgtaagcctggaaatatgcacacatgggcaaggctgcatgcacacagggaaaacaaggaagggcccgggctatccacacatccctgattgcatgtgagtgctcgcacatacacaggggagacacaggaaataaaaagctggggcagaatatcaccaaacttgatgttacccaacctacacagggatccttgggaaaaggtggaagccacattggctcaaggtgtttaaacatacactgtaataattcacaggataactaagctgtcctaacacagtgagtggtaacttccaggaaaccagacttaagagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcaccatcactggtcatcagagaaatgcaaattaaaaccacaatgagataccatctcacaccagttagaatggcaatcattaaaaagtcaggaaacaacaggtgctggagaggatgtggagaaataggaacacttttacaaggttggtgggactgtaaactagttcaaccattgtggaagtcactgtggcgattcctcagggatctagaactagaaataccatttgaaccagccatcccattactgggtatatacccaaaggactataaatcatgctgctataaagacatatgcacacgtatgtttattgcggcactattcacaatagcaaagacttggaaccaacccaaatgtccaacaatgatagactggattaagaaaatgtggcacatacacaccatggaatactatgcagccataaaaaatgatgagttcatgtcctttgtagggacatggatgaaattggaaatcatcactctcagtaaactatcgcaaggacaaaaaaccaaacaccatatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaagtaataaaaaaaagatttttaaagatgcacaatcatcaatatgtatacactgcaggggatacagacttcatagaattagttcagacaagaaatgaaacaaacagtaatggcaataaaacatgggagggagtgcccagaattgagatgctgccatatattatttaaaatgtgtagtttaaaaaaaaatccaactcctggatttgttgatcttttgaatggtttttcgtgtctcaatccccctcagttcacctctgattttggttacttcatgtcttctgctagctttgggatttgtttgctcttggttttctagttatttttgttgtgatgttaggttgttaacttgatgtctttctaactttttgatgtgggcatttagggctatacatttccctcttaacactgccttagctgtgtcccagtgattctggtatgttgtatctttgttctcattcatttcgaagaacttcttgatctctgccttaatttcattatttacccaaaagtcatacaggagcaagttattcaatttccatgtaattgtatggttttgagtgaatttcttagtcttgatttctcatttgattgtgctgtggttcaagagattgattgttatgatttcatttcttttgcataagcaaaaccctccatggatcaaggaagagatcataaggaattaatcttccttgtgaatattaacaataatattccttgtgaacagcctttatttcaacctgaatgaaaataaatgcatagtgtatcaaatcttgtaggatgtaggtaaagcaacgctaagagaaaatttacagttttacacagcaatattagaaaagaagaatctgaaaacagtaccctaagcttctaccttaaaaaactggaagcagaagcgcaaactaaacccaaagccaacagattttattatgaaaagtttcagaagaggcaaatttattgtgacagaaagcagattactggttgcctagggcttggggtggggaggaagactgactgtaaacaggctaaaggaatccttttgaagtgatagaaaatgttctaaaactaaattagaatgatgattatgtaaccctataaacgtacataaaatcattgaattacacaactaaaatgaatgaatttaactgtatgcaatttatacctcaataaaactattaaaatataatgacccaattggcagtggaaaatatgcatatggatatgtgtatgtaccacaaattaaagaaattcaatattcttaaattgagctattccgtgttaagcacaggcatgaatttgaaaacgagaaacttatttaatcctgttccttaaaattgtgtaggcaataaaatatcctcttctaattttactcactaaaaataaaatacttaaatatagtatttggctattgacaacttttgaaattaaaagttctatttaataactaaatgttatttgtccctaaggtattaagtcaaaagctggctctgtaaatagcttggcaattactcataagttttttaaatgttatcagcgtaaacttgtcttgtctcacctctttagcaagatacactgatttcaagtggaattatattaatgttgaagtaagtaacagtaattttggtgaatgatttatagacatactgtatacgtactgtcaaaatgaccgagatatactttcaactgatacagtcaggggcaacattctgcaataaaactgatataaatctgaattccattggtcaaaatttcaatataaaatggatttacacaatcctgaaaccctgaaaagaattcatctgggtcctaaatactgaataatcttttaaaaatgtttttaggtgtaaataaatctatgttaaatcaaaccatttggaattggaaattttgaaccatattaagggaagttggggaattgaatttttcttggaaaattagggttctgagaaaaaataatttagattctttcaatttaaaagcccattcatttctaaatctgatggaaaagataagaactaaaaagagcatgtcatgcactgtcaatacaagaattatttcttgtagggagtgaaaaatcttagacactatcatgatctgtggccttcctagggccagagtacataaaccaaatacagtatacctgtgatattaaagtgtcattggggaatattcagaaaaaaaaaagtctgaaaagaatccttagtggggagataatttaaaaaaacgctgagaaacactggtatagaagacacttctacagataaatcaatttatttggctctacctcccaacgtccatggaaaaaaaaaaatctcactataggtaagagcctgtgggttacctttacaaaactgaactctttctacttgataatgtgaaatgacattaagaatgcaagaaacatttctagagcatatctagaggctgtatccaaaaaatcaagattgtttctcatctttaagccataaatcaaatgaacacaataattacatataggcaaattacaaagttatctcacagaaaaattgatcttttgatttttactttcataatatgtaaattccatgtaaaaatccagtatacggctctgtcaatggcaaaaaaaaaaaaaaaaaaaaaaaaaatcttgtacttttcttatcctgcagctgctgaataaaaacagtgaaaactgtgctaatttagtacactggcattttctttgctgacctaaattataaaggactgacttcaagaccatcaaggaaactaattttaaacactaattacatctagtatgtaatatagttattcaaaagtagcaacatagatgcattaaaagaacttgcgtagtataacttcagaacagttagtgcacatatcgttttcagaattatttgaaaaataaactagccaatgtcaaatcttagtttgatttgattcattacttttagggttcaaagatgtatccattatgatccctttcctaattttatcctgagttgctttcactccatcttaccaagtaagttttctttacaataaaaaaattgcaaaacttcctagctgaattcaatgtatctatttctttcagtataaagaatcaagttactccttaaaaattagcagttctaccaatattattccaaaaaaaattatatgtaggaatagagggcacattcagaaatagtaaagcagcttcttcaagaaacttaacacttggggaggccgaggcggttggatcatgaggtcaggagatcgagaccatcttggctaacatggtgaaaccccatttctactaaaaatacaaaacattagctgggcgtcgtggcaggcacctgcagtcccagctacttgggaggctgaggcaggagaatggcgtgaacccgggaggcagagcttgcagtgagccaagactgtgccactgcactccagcctgggcgacagagtgagactccatctcagaaaaaaaaaagaaacttaaaattttttaaagaaattactactttagtatttagttggccacgtattttctcaacaattttcaaaatttgatgaatcttgatgaatcaaaaatttgatgaatcttgttttatcaacatttcatttgtataaggaagcataaacattacacacatatgcaatgcacacatttttaatgaccttcaaaatgatgggcaacacattagactatattcacgattctaaggaaaaaaaacaatttaaatacaattttaaaagttttaaggatagtcaatcagaggcagcgtcttggctaaattttgttctaaaatttaaagaaatttctaacaagtctatactgtctaactgccgcaatattatctcccactttagccaatggtattgaatttttatgatttagatactgtgatggataatttgaaatgtcaccttggctggaccacagtaagcagatattttatttaaaacatctggatgtttctgtgaaggtaggcttttttataagatcaaagtttaaatcagtagacactgagtaaagcagattactctctaaaatgtgggcggacctcatcgaatcagtagaaggccttaagaaaaagaaggacctatcccaagagcgaaggaattctgccagcagacagccttcagactcacatcaactatttctgggtctccagtctgctgcctacttgaccttgcagatttagacttgccagcctccaaattcatatgaaccaattctttaaaatctctctctctctctctcatacacacacacacacacacacacacacacacacacacacacacacacatcctattggttctgtttctctagagaaccatgactactgtagatttatatttttttctaattttcaagatagtataatattactaaaggttttaaataaagtattaataatgcccaatataatattgaaatacaaaaattattaaaattcatggttctctctatgtagataaaaagagatgctggatggatagatggacagacagacaggagagtagagcaagcaatatttctcccattccttctatttttctatggcaaatatcgatgagcagtaactgtggagcaaagtaggttaaagactgcaggcaagtttaaccgacacagctaaccagcatcctacactgcatcagggatatgcagctctttttatcagggaaggaaacatgttcagataagcaaagatggatctctaaggtcacaaaacctctgatggaagagccagaaatagagctgcctctccttatatctgagatgtactcttcagttgaaataacttttcctaggtgtatgttccttaatatgtatgcatatgaatataaacccgtgtgcacatatgtgtgtatttgactatatatgcatatatgtttgtgtatacatgcatatgagtgtgcgtgtgtgtgtgtatttcagtgaaaaatcctatacctggcaaacaatatatgtttgttctcttaccttgtctcctgctgacaagagatcccaaatcttatcttcggattataattgtaatcaaggactagaatcattccccaatgccttcgttaccacaactgttatttctttttttttaaatttaaataacttaatattgtctgtttgcactggaattaggatctcaatctaaggaccttgtcttattcttcctgcacctaaattaaaatacctactgaatagccaggtacgcaatgtgaaacagaggcaatgactcacttcaatgccatagtcagtgtttgacagacagatgggcccaggctctcggggaataaagaggacagaaattttgcccagagtgaaagggaatgagagtgtgtgaatgtggctgggggattagtgaatgtgtttagggaggaattcatagaggtaacaaaacctagtataaatcttaaaggttgaaaggagaaagtcttagtaaaaaaaaaaaaaaaaaaaaaaaaggcggggggaagaaaagtgatctgggtgatgaaaataaagcacatcagggctatggacacacaaagggccaggaaggggacccagctggagcagcctggaggagggtgtgatacggttatgatcgcattgctgtgacaattgctgttacagaaggagaagcagggagcaagactgaaggcgggaaaactaattaggaagctagagctttagactggaagagaaaaaaggcaaagactcaggtgttaggacacaggtaataaggctataggtgaggggtgaatttgaaaaactacttaggcagcaaaaaattcaggtcctgctgaatgtttagaattggatgagagggagaagcaatatgaagaaaaatccaaagattttagctgagctagaaaatgtagacagaaaaacagatccagatcagggcaagggaaagaaaagcaggaaagagatgataacaccatgaacgcaaagttcctgtggaacattctgacggagaggttcactaatccattgaatatgggggtttggagctcatgaaagaagtcaaggtggaaatagagatttcatgaccagcagtacatgaggagttaaaactatggtaattactgagatcacttgggcaaagcaccattgttaaactgggatcacttctcatcgacttttcccctagtcctcagtctgtttatctacattatctacctaatcttgcttaggacttaatggtaccaagtattgtctcttcttcccagaagaaaaatgagtgaacttggatcttcttcccctccagagggatgtggcaggttgagttgctatggattctgaggaagagagaggaagaagcgcccctaagtaaaagctttttattccatatctttacactgcttgtccattcccaaattctgctgtatgtgtatgcatatgtgtgggttttttttttcagaaataagacctgtttgtgatattcatgtaatacatacaaaaatacaaaggaaacactcgtcacttcctcccccatctgaagtaaccagccaattatattttcagtaatatatcattccacaatagtgggcctagtgttgtacactaggatgggaagtacatacctctcctatcctttggtcaaaattaacaacataacaagaagatagtgcaggcgtgtacgcatgcacacagatgcatgccatcaaagtcaataacaaaacaaaaagattcaggagacatagaggtagcatgaccagtagagaagagcagttgttgtagttgtattcattcatttgacaacaattagttgtcttaagtacatttgcaggtgtctgagatataagtgtacataagactgccaatatcctcacggagtttatagtctagccaacaaaacagacaaatgaatataaataaataaatacatgattacaacagactttgttaagaagtcaaatatatgtggcttagtacagggctgagagagaagagcaatggaagagaaagaagtacattcctctcctatgcaactgcatggcattgagaaatcttgcctttaacatcttggttttagaacttgcattttgtttgctttccataaaatatttgttagagcagatagcatcacatgcgtttgtgatttcaacagacaaccctcttaacctgcaaagaatcagatgactcaaaccctatttcacttcaaatgttatttgctctcctgctctatttaggactgccctaagctttttggtcacccttataacttctgtttttaattattgagtctttaatcattgcctattcaaattgggctttatgtatctaagtctattaggaataaaaatgcaggaagactacaaatgtatgaagatttcacacagagagtaaatattttgtatttgggattagtgtgaggcaaaatggtaaaaaggcaaagtcagctttctgaatacatcatcctcccttttggcccttccttcagcaagcccttttgctgcagtacttaatcctgtcccatcaccttcatgtcctaattcacatcaaggtgttgctgtttcaatttccagccacaaagaaggacaaagtaacaggtgttaattcttaacctaaagtaatgtatctctctgaacatagaatattaagaccaggctgctgttcttgggtagagaaaatcatctcttcctttaaattacactacagcacatgcttctatcagcagtcaagctgcacaccaaagatattcttaaaagccatgtaatttcaatgtacttaacacatagaaaatgttctaagatggagatagatgggagttaaggagaaatgcaatatatggtttatgtcttgagaaactttggcttgctaggtcacaaggtacacagaaccaggtataaaatggctaaaacctaaatattaatgtgaacatttaatacatatcatacaaataaatactagcatttcttcattactacttcattcattcaacaagcctttaccttgtgtttactgcttacaggcactatggaaggcagtggcagtggacagccacgatatggccttgtgaggggttcagttgagtgacgacatgatggtgaatactcaataaatatgtgctgaatttataagctcaaaatagcatgtgctggagatacccacagcatgtaaagaggaatagaagagtgtcactactcctgactggaagtcctggtgttagaggaaggggtatagatttgtggactaacagaaaagcaagtctcactgctgctggagttgagtcttgaagaaacaaaagcagaggaaaacatcctttgaaaaggtacagatcaggccaggtgcagtggctcacgcctgtaatcccagcactttgggagggtgaggcgggtggatcacttgaggtcaagggttcgagacaagcctggccaacatggtgaaaccccatctctactaaaaatacaaaaaattagccaggcgtggtagtgcacacttctaatcccagctactcaggaggctgaggcatgagaatcacttgaacccaggaggcagaggttgccgtgagccgagatcaagccactatactccagcctgggccacagagcgagactccatctcaaaaaaaaaagaaaagaaaaaaagaaaaggtacagatcaaagacaaaacaaacaaaataaaggaaaataatgcacataactgtgtacagctgaggcactgggggtgcacgggtgatggtcaacaaagctcctagagtcagcttacactaaaaagtttggcctttattctgcttagtgtagacagtgggcagccactgagtacatttcatcaagagaaaggcacatttgaattttggcaagatcactctaataatgatggtgtcaacaatggattacaggggaggaggaaataaaacagctacagtaataatctaagagaaagtcatgaagtcctgagtaaggcagaaactgaagacaagcaggaggaatggacaggaagggccagattcaggagatattaaagaagcagaatccatagaaagtggaagctataaacactgggcaatggaggtgagaaaacaagcaagtgaggaagtgggaggcatcaaaggaagctcctaggattccagcgtggaggaaagggaatccaaggatgaatgaaatgtaactcggccatctcaggccaccactgtttgcacctggtgcccacctccaggttagctagatcaaaacatgcatctgcacacacataagcacatatgtacaggtgcacatacacgcatatgaacaatcacacaatctggtgatcccttcctctcatctacatctcttctttttcttcctctcgcctctgcaacatacacactctggaattttcagttgacacctttatcacatagagtatttattagcccttatttcttttctttaattcgtctctcattccccactcagccaaagaaagggtcctccctagacttgcatttctcaggaatctggacagtagttggtgtaaacacttagttcaacatatttatcctgtctaataaatttagataggagcaagtttgctaggaaagataagtatttctgttttggatatattgttttaagtaggcaacaattggagtcaccgaaaaaaaagaaaagaaaaaagaacctgaaagcatttaacaatataattcaaggagagtataaagacaataaaagtaatatttcactctatagatgtaaagggacatggttttctgggaaaactaatcacagaaatgatccacactaacttataatctaacaaagttacttgtctgtaaaactaaagaagtatttggagagccaggcaaaaagactatttatatggggaacgcatgaccaggctggccactgaccacatatcactgtctagaggactatggaacaatgcttccaaaattcgtaagaaaacacaaacacacaaaaagaaaggaatggaaaatgtaacttagaaattttatactatcccaagatggcatggaggtgaaaaagaaacataccaacattttttaaaaatgcaaaaacattaagtaatatattttccatgagtattaatttattattgaaagtactagagctacccagagatgaatgaaaaaactatagcacaagattggcaggggcactgaatctattcaatggcataactaagggtaaacaaatgcaggattatggctatacaagagaagacagatactgcatgaaaagttgaaaaagagtaaaaaaaatgacatatagtttaaagattctcattttctcttctttaaatcttgagatgacatatcatttaaatccagtaaatcacacaatgatggttttcagtgtgttcaccagtaaaaaggtaaatgttaagaaatacaatttgccagtaaaataccaatacaatttaccagtaaaaaggtaaatgttaagaaatacagtcacgtggtgtgacaaatagttaagaagtgagaaaatacagttatttcaacattgaccatattagggagtgaaaaaaatactgtcctaatgaaatataagtatgggtaacatgtcaatttgtagtttaaatatatctactagattggaaataaagaaaaggaaatggacaaattttaactatattaatagaaaaactgacaagaaaaaaataaaatatcacttctcttctagttatttagaggatttattgcttttcaaacaaataattaatgcataattcacataaataaatttgactcacataattttggaagaaaatccagaaattaaattgtatttgagcactctatgattgcgatctcttctttcttctaccttttattagatgcaattttatcactttaccatagcactttccactgatttggtagttttcacctaagagttccaaatgtgtttttcagtgaaatattaataaatgcatgctgatgaggaacgaagctacagaatgacagtcaaagatcatacagcagtatttggattcgttgaattaaattaatccaaaaattttggtcctgttaatacttttcacccaacttgagcttcaacaggaatggaagttttattgttagcattcaattatatattaagcaaccaaacatattctgtcttttatttgctcagcactgtgccacaacaatatatagctccaaaagccacttgtctacttggtgataaatagatttaagttttcgaaactgagaccaaccaacctgagaccaaagctatgttcttctttctaaagcaaatgattttctaagctttatttgatctaccagagcctcctagattgatttgatttcaacattacaatgaagaagcagtggaacaatgttatttcactctcatcactgtgagttttaaacatcatactagtctgtacacactatggcagggctcaagatgtatctgtgcaaaagcctggtaagtaagaagcaatagaataaaatcctttcaattgaattatgatttgagagttgaatttatcatactaaatgttttcttcaaacagagtacatccttatttccagttaatatttaagactatccatacatcaagctcattgcttacagatatgcaaaacaactgtttttctcttcatcagtttaaactcacaatttataactgtgatatatagacatttggcaaacacagatgattttaatttataatgcacctctatttgatatatcaatataaaaggtaattctatagattatacaaggagaagaacctttcagaagagcttgaaaacactgaattatacttgatgatagaaagtatcaaatagatacctaaagccatcatgaacttaaataatgcttggcatctataaaggaattatttcaaatacagtatgtcggccaaggcaccaaccagctgttaatgtcactgggctctcctatgcaacttacaaaattatttttgagtatattcagtaattacttttggcacatactccagttccataacctgttctcgtctatctcaagagctttcaatctgattacattttccatgatgtaaaagcacaactccctttgtggaatccacgtagaaatcactgaattctgtgttcttcctccctttgctttatctcacataccccatactgttattaatggttatttgaatttcagtggaaataaaagtgatcaatctttactgcaaccacagataataggcatcctagtactcctatttcaaggcgtggtgtttatcatttcttaagaaggaatatccattaatttaggatataatagttttagaccaaagataactaatgtcaagaggaaactttctatatcagaagaataactggccttcagtcttaaaagaacagtcttgtaagaaagtcagggtgtatttcaagaacgattctgagcacttggtcagtgattcttaatgggttgtgtttctctctgtaaatcctcggtagaggtggaattaattttatttaacagattcatcaggcgcttattggacacagagcagagccctgggttttcaggtgttcgaacttggcattgtgcattggggcactaaactatcaacctaaaaccatctgaagtacacttaaaatataatttccttgacaatggttatctagattacttaaagattaggtgatctggtgtgagtataactttggcagaagtttctgacatcataaattctgaatccatccagtgattgaatagaaagaattgttcacttcccaacatattaaactttcaaaggtctgtgactctgccatacaagccaggcatttccaagagctcggaagtcactgttatgcatttcccattctcacacacacacatacacgcttgcacacacacagttcagtcataatggctacatttgtggatgatgctccctctagaactggatgcacaagagaataagaaatgaccagtgatgcaccctgcctcttgcaaactggagagagcatttactaccattctcatccactcaagaagagaatcaagttctgaatagaaaagaactatcatattcctctaaattcatgattcccagattctgagctaattttcttatgaaaatacattgcttaaaaatgtcaagtatttataaaaactctaaaatgaactttagtgattggccatggttttgtcagtttgagaaaacatggaatgtattttgatctcactgagatgaataataaacatttcctttcaaaggataaacaagttttattgaagagcttacactccttaggaattttaaattaacttaatcttcagtcacttacaaaaaaattcttttatattgtccttatattatgacatgtaaattattactttcttataaaatacataatccacactattgagtaatatacacacagtcatgattcactttgaaaagaagccaaaaaaattcttaataaaaatggtgttggaatggaaaatagcttatctcatacactgttggtggcagtgtaaatcagtagagccttttcagaagacaacttggctgtattaataaagagtatgtacctttgattttcaaattctacaatttggaatccatcatttataagtataatcatatatgcacaaaactatgtttaagaatgtttgttacattaataatagcataattacttaacctttactgagcatgtactttggagtatggccaaattaaatccatattacagaatgatatgaaatctatctatttttgtctatgtgtttttatatatacatattataaaatatatatatcacttttcaatcttttttctaatatataacatatattagaaatattgtatataaaatttatattatatatatttgaaaaaagtctgcaaagatactacaaactatggttatctatacggaagactactgaatgggggaggtgtggaatggggaagccaggaaagaggtaagaataaaagtcttcgcattttacattttatttttcacatttagttttgtgttacttacattgaacatgtaactctatcacttttcaattaaaaatttagaaggtatgttaacaggaccaatgcaatacattataactttttaacgacaaaatcattctgtataattaagcttaaacatctaaagagtatggtcaggaaatagaattaacactcaaattgaggtaggtttgattgtcttattggtaagtaggtttgataccttgagacgaaatatcaagatttatcttctatgaacctacaaactgaattattaaaaccaaaatcaacaaataaaatcaagctcttagagtgcttaagaatccatggtggggaggcacactacacaatttgaaagcacctaaggtgctccgtacctaatatgtactccatcagggtaggtatcttgtcctcttgagaactttaacttactacttaatctgaacccattttatctgtttttatttccaactctttcctaaatagatcttccctcctaacagcttggttgtgtcacagttccataaacaccattccatgaacctcattcattcttactatttagctctgcatttaataaacttggggttcctcctcagctaacatcctctctcctgggagctctttgacaactacacacccaccactcccctccagagagagtgagtccctgcttatccatgttcacagcatgtgatctcctgtgccgcgtgaccacagttgataggaccaagggttgatcctttactcatgatctaaacagctcagatgttctctcttaataatttaactaacagagtcaagactgaatcaattactagtagttcttggagctggaaaatcatatagaatgggaaactatggaagccccaggggctatgtgtactaattatttagcagagagagtcaggttgcagacatttaaaagcagaaacaggaaccaggtgatgagagaacaagagaggagaaaagaagagtagaggagatgggacaggaatagctgctttgttccccaggctttttagctctactcccaagaaaacccagtgtgtcttcattttctttggttatccagaatactactgccatcttttaataaatattttcttagagaagctaatttgacaggctttctgtgtcttagatacctgatggggaacttcccttttgactgtccctatatcaattctacatctttcaaggcccacccaaattcttcctttttcttgaatcacatgaaaagataaggacatgatgccaactcataccaatcattcctgaatacatcacacaaaatctgcacttcataatttaagctgagatgggagcaactttcacttgtgaaacaatgcctttgatagactataactcactagactgaaaccctccttagggcagaggtaaagtgttgtatttcttcaatagtttctataattggagcactccagtaggcattccagaaatatgttaattaagttgctgagcccatgttccaaaaatataactgaatctcactcaactgaaataagtaattaagtatagattctaatataaggcattgagatctaacaagaatatttaaatgaaagaagagatccttaaaaagatgttttgtgctagaaaatttaagccaattttgaaaaatgaataaaccaatatacattacttagatatttaaagcacatgtggcaagcattaatcccatgttcaaaactcagatgcaatctcatggagaaataaaatagagcaagtgaaatattattgctaatgtgttgtactccttacacacaaatgtccttccaggaaaagaataaatgagatagatgaaaaagtcaagtaaaattatactcatgactatgaataggacttgtagtttaaggattttaataatgaggagtaatatcacaaacatacacttcttgatgatttcccaaatatcacttactggaaaataaaacgaatatcattacattttgaaaattattcttgttacagtttccactaaaacaaaagaaaatcaccacctcttcaaaattacaatgacctttaagaagttgccaatttaacaaggactagaggggagtcctgggcatttgcccttgactgcagaatgtaagtctaccaataaataaaaatggagggtaaagactcatagaagaaagggagtcagatattaacacattctttcctttgctttctactcacaaatcactccctttccccctttactatagatgatctatgtgaaggttggttacttctatacatgctcccagtctcaagaagcataccaagctgagcgcttaagggatataatggagaatagaatctaatctagcagatattcaccataaactctcttttaatctttaccaaactctgacttcctatctgtgcaccccgttctggctttgccatatcattaatatgtttcccagaatcttaactctcggcttgtatactaattaacgaaactcatctccttcactcagacacagcattgatgagatacatctttgtcatttgatccactgttccagcatcaggactcagcctctcttgagatatgttccagaaggcagcttaatgatgcagctgccaatatggttctccactggtacatacatgtgacttccctccctattgacctgattaaagcagatgtattacagtgtgaggcacaccctattttcacattcgaggagctttagctgacaatcaagaatactcatttaatttatttccaaccaaccatcattaatttccaactggcttatcatacatagtatcacccaggtggttaacactatatattttatagttaacgattcaaaatggttgaaatagagatgatgaaaaagacttccccatgttaaaattattgtgcttttgctccctaaagcctagaagtttgactttgtatggccattcttctatctattggagtgggcctacaattgttttcagagatgattgcatgatacatagacaaatagatagacataaaaaatgaacaatctgataactattcaacagtgaagtgcatttacatcatataatataagcagaatgatgcccaattgataaaagctatagtgagcatatttcaaaagaaccagtcctcaggtaataactgatgaatcttctacttactccaaaatcttcaaaaataatcttctgtggaataaagtaaaagtatctagatgggtatcactaattatgctgtctgttatttcatacttaagatgtgtttcttacctcctttctaacagtctgtcctgcttttcctttctgttaattccatgttctagcagattaagaatctgacaatggagtcccccgtttcctactcctttgacatttaaccttcctctctctctaacatgtttgttcaaatcctattcagccttcaaagcccaactaaaacatcaccatgtttaggagatctttcttgatttcttcatactgataggctctctttccactctaaggttccaggcacttgcttattgtattagtctgttttcatgctgctgataaagacatacctgagactgggtaatttataagaaaatgaggtttaggactcacagttccacgtggctggggaggcctcacaattatggcggaaggcaaaagacacgtcttacacggcggcagacaagagagggagtgatagccaagtgaaaggagaaacttcttataaaaccgtgagatctcatgagacttattcaccaccaaaagaatagcacgggaaagacttgcccccatgattcaattatttcccactaggtccctcccacaacatgtgggaattatgggaattacaatacaagatgagatttgggtgggaacacagccaagccatatctcttatatttatctaattgttcttatgtcacccagtacagcggaatggctaagagtcagactctgcagtcagatgcagctggagtcccattcccagcacacctcactaaactttaatttcttcatatatataacgaggataattgtaagagttaccttgcagcattttcaaaatattaagtactcaataaagtttagccattattagatattttaaaattatgcattatggttgtcagcatttatttccatattttgaaattttttctctaagaaaaatctactaattgatcatgagaaaaaaaataactggggccaataaaaacagcattatgctttttttttttttttttaagtattacttcttggtatgaaactgttttggaaagttccttactctgtaactaataaaaccactggaacaaatctggaggacaatcagttactttgcaattaaaaaaacctatgttttgtatatctcaggtctttggctcctgggtttaaataaaatacttacttgctaactctaaaagataggaatgctaattcagtttttggaaaaggctatatgaaaaatgaaacctttcctgtattctttgttttatatttcatgctatctcacatgtatacaattctcacttcagtatactactttaggcataataaagatttaagaaagatttattaaataggtctcctgaagttgtttaaatcaaacacgaatttgaccctgcagttcagcaacataggttaaatggccacacactggattacttgaaagccagggcaactaagaaccttggaaaccaaagaatgtatatagggccagccagtatatcagtaactgtatttagaattcacagaggataaccagccatgtctttccattacattatcttgcctaatagaggtcaaatgactgatctgcctgctaacagagtttagcaaaggaatcagaggttaattaccttcactcctttttacaaaagctaaatgtcctaagaattactgcatcattatccagatagaacaaaagcacaaacaaaacattaaaacattacctggggaataatgttctaatattcatctaactgaaaggtcattatctctagaactttaacttttaaaattcaactactgtgcaagcatatttattaatgagtaaaataatatgtacttaaactcaaaatatttagtacattaatgggattttcatggttttcattagcattcattttccttttccttacataattaaattttgaaaatataatcctaataaaatgggcatgtaagatatctccctctagtttactggcaggagcttgtactagaaacagcattagacagggagataagagacctgggttttaaacctatcagttactgaacaagctctgtatgcacttagacaaaaccgagtatccttgctcattaaaaaaaaagggatgtttacctatgagaatcaagtagaactgctttctgactatgctatgtagaatgcgaagtgattaaacatcacagattattatacttccttttgataacccacataatatgaccatgtgactgttttaagtaaccaaatggagaaaacacaaatatcatgatattgaaggaaagaagcagaattgttccatctccatttgaacctactctactggcacatctaatccacaagtttgaggatgagattaagtgcaaccatttcaatggctcctaccaaataaataaaataactctggatcaattatccagactcagggaaatggaaaagattagtgtaaaacaccctttcactctgctaataagatgtacaaaagtcaaaacagcttccatacactatggtaatgtcataaaatggtaaattgagccatgcgacaagcaatttcaccctctcaaataactttggtcaacagcaacgagacttactcctaaattgagtgctaatgacagaattgaagatattattcaatattctatctgatggataatgaaaagtaaatgtttaacctacctaatatcggctttatccaagtttcttagggtccagggaggacatttgcagagctaaattttcattgtgaaggcaactgcacacactaagtctgatttcgaaagatctctctcttctcagagaagttattaagttaatatgttgaaatttattagactagcacctggatcttagtaagtgctcagcaagttgagatccttataattattattattactgatctgataaccatctttgtgttcatgtggaaccatccagtccactttgatgacagaatgtaatagcagggattagttcattttcatacaccatatcttgttcatcaaaggaattttatttttcatctttggaaaacaggttgaaccttttaagagcaatagtgtgagttttcctttgttattttttaacatcagggctaactctagatcaaatactctctctatatttcctcgtactaatatagctgaatttaccctatcctcatttatcatttcaacaatcaaaaaggtcagaatgccgaccaatcgagaaagactacctagcctatctgaaggctagaccctgtaatttcacaggcagtgtcttctcagaatactattctattgctttttattattagaaaacaaacaaaaatctatcttattcactgacctagtaaacatgaacaaccccaaattttccattaactgatattagaaattagaatatctttgatgctttgttggattcatcctacatctttgctttcaaagtttttccaacccctgctccttttctctccactccctttatcttctttgctgattccgaactccactgtggctgtaatgcctccctaatgcctgcaacagtgcctcattgccatggaaataatcactttaaaaaacaatacaatacaatacaataagtaataatgaaagcttaggcaggctgtacagtaggaagggagggtagactcagaaatagaacccagacttactgacactaacagctactcccttaatgtagtccttagatcactaaattcctctcttattttcactctcattttcatatacatactctccgatgatctcaggcagcatatagattttgaataaagaaaatgccaaagtagcagtgagacaatgaaacttgttcgataattatttgagatcatagctagtgtacaacctgtatgttcaggaaaagttagctctcaaaatgccctcctcagaccccctgaaatctgggtcaaaacggcattagattggatatttgtttttcattcttttttagttacatcatcacaatactttcatttttttttcccaaaccttagcagaaaactctgttgttgatcacatctgatttgagagatgcagattgctggttgctgccaggaataatgtgtcacattatataaataaataaaacaagcgccatgggaatgagcagtaggcacctcacagaaaccaccgggtagcatccaattgacaggctgttctaggaaaagaaatctacagattcagggctgtcaccatccagagacttctaaaacaagatacataatacaaatacacacaaatataatacattggaaagtaaatttatttttttacatgttactttcattgctttagttacgaataatttcatagtagtggtggagccatgtggaatccagttagagtaaacatgcctgtaaattggcactaatgttatgctgttgttgaaatcacttttgtagagaatatgaactttctgtaggtatttagaggaaagcttatgaaagcttttcaagcacagaaaagcacaaagaaatatatggaatgagaactgggactttaagaagctgcctcaaggatttagaaaatggcctggtgtgggctaaatgaagtgtcacatttaagggtcatttcctcaacaaacatttgaatgtgtttgtgacaagggattgctgggggctggggaagggggtggctacaatgatagctatgacttcttcttatgtccccgttctaatatagctaaatttatcctatcctcatttatcattttgacaatcagaaaggtcagaatgccgaccagatcgagaaagactacctagactatctgaaggctagatcctgtaatttcccaggcagtgtcttctcagaatagtattccatttctttttattattagaagacaaacaaaaatctgactatcttattcactgacctagtaaacatgaacaaccccaaattttccattaactgacattagggactcaaacattccatcaggagattacagtccactggatatggcaaattatcaaatataactatagtccatcatgattaatgtcacattagctataagtagaagcaagaatgacagtgatgtaacagttttaagtgagctgtagttgtatagccagtcgacctgtccaaggtcaaagagctggctcagagttaatacaggtgataatgggaaaatatgggcatgagttttcttaggtctatagagtaatgagaaagatcacatatgcagagtatttaaaaggaaatagggatatgggcagcaactcttttagagaccattacaaactgactgtctgggagaacaacactctgaggcccaggtatgtgagaatgaaaataagcaaacagaaagtagggctatgtttagaatggagaagatgctggttaaagcaaaagaaatgaggcaaagaaagaaagataggagagcatcaggttgcataataggggtaattagggtataaaatctgtggagcatgactgtttggggtgaaagagaaatgtggcctctataatattctgagataagtaagagtaaactacctttctaagtcactcgcaatgaaacaagatttaagttagtatggggatgatgctgttattcttcaatatttagggaccacccattgtgttctaaatacctaaaccctcattggaattgtaataaaaaccatgggactggatgaaaaggataagatgaagaaatgagggagcaaggttgagtgaaaaggtaggcaatatcaatcagtcaagaggcatttattaagcctctataacaaacacacctgcacagcatttttctagattctttggggagtaaaaaaagaatttaatagtctgattgggaaataagccacatttgagtgaaaataaaccacacaaggctatacataagtaattaatgtaataaagatttaagctgggccatatatgtgaccagacgatgattttaaaatgttattataagtaattgtgatggaagtatattgtttaaatggaaataaatacacttcattttaatttcatgactattatgctgcttattctagggcatacttctaattatgtctcttgctcataagaacaaactgtcttctgcactatctctaagtccagtgctttctctatgacattttgggggacaactaagctgtctagaataaatgcacatacagcagaagggaagaatgaagaagaaatgcagctgaggaagttaagtaaagaaaggcacaggtttgggaggctgaggcgggcagatcatgaggtcaggagttcgggactagcctggccagcatggcgaaaccccgtctctactaaaaatacaaaaattagtcgggcatggtggtgtgtgcctgtagtcccagctacttgggaggctgaggcaggagaatcacttgaacccgggaggtggatgctgcagtgagctgagatcacaccactgcactccagcctgggtgacagagactccatcacacatacacacacacacacacacacacacacacacacacacacacacactcaaaaggcccaggtaatgaagtgtctcttttgccaagctcaggaaattggactgttctctacagggactgagtgcctagtggggaagaatcggggtcagcagtgtggaggacggagtggaagctaggcataaacagtgagctaaagtcatatttaaatctttgcaatatttcaagagacaaatgaggctctgaattagggtaagggcaatgctaaagagtgttaagaaatgcagcagacaggacacagtaaagtaaaacatagagaggggaaactcaagaatgacactcaagtttctgattagaggatggtgaagctaatgaccaagaaggagacggtttcgaaggaaaaaatggtttcagttttgcacatgtgcctgtggcacatccatagggaagtatgtaggaggtagatggatatgcagcttggaacgcaggagacattccttcacctggagatactagagctaggggtcattagtgaagaaagccattggagctgcgggaaagggtgagcttgcctagagggtacatatagttcaggaacagaaccattaggacaatggcatttaaggaatgggtaaaggcagaaagaaattggtgaagaaaaataaggagtcatgttgtactgaaactattgcaggtaagatgcccaaatttttctttatcacagtctttacaaacttcagacttcatattaggaaggaaaaagttactctcccccacccgctggctattacttacagccaaagacatcttaactgtaaagtatctgatataattttaacaattatctcatatacgtatcaggaaagtaacaaccacaatgagatatcacctcacacccatcaggttggctactatcaaaacaaaaacaaaaaaagaaaataatgtcagtgaggatgtggagaaactggagcccttgtctactgttgacgggagtgtaaaatagtacagccactctgaaaaagtttggcagttcctcaaaatattaaaaattgagttgtcataagatccagcagttccacttctgggtatatggccaaaaacattgaaagcaatgtcttgaagtgacacttgtacacctatgttcatagtagcactattcacaataactaaaaagtggaagcaacacaactgatcattgatggatgaatggatgaacaaaatatgatatatagaaactatgaattattattcatccttaaaaaggaaggacattctaacacatgctacaacacggatgaaccttgagaacattatactaagtaaaataagccagtcacaaaaagatgaatactttatgattctacttaaatgaagtgtctagaatagtcaaattcacagcaagagaaataaagtagaatgatggctgccaaggggtacgggtaggggaaaatggggagttctttaatgggcatagagtttcagttttgtaagaggaaaaatttctgaagactgattgcacaaaaatatgaatgtacttaacactactgaactgtacacttaaaaatggctgacatggtaaatttaatgttctgtgtaatttactacaatggaaaattgtataaagcaactgaatggtgacagcaaaaacagattgactgtagaatgattttctatgattggttaaattaaatgatttttattttcttctttatcttcatggattatccaaaattactacaatgggatgtgtaccttttatagtcaaaatagaagttattccaatgaactagttcacactacccattatacgcaaattgatgtacatctccaatgtgctttcagagcaactgcattattctgttatattctgtgtcacgagtttgctgttggcacacaatgacgtctattaagatgcacatcaattactataacctgcaattaataatgcatagtttaaatattactggtgaatagtcttcattattaaatctagatgtctatttccttcatgtttctaagatacttctacttcaagattaattcatttaatttaactgaacatcagctacatgtagggcactgtgttagtccctccagtggctacagggctaaatgaggtatggtttttgatcttaagaaatacattctaatagtgtattgtattgttctccaaaatattctctgcccttccttatggagagaatatatgtccccataccatgttggcccataacaaattgtgtgaaaaaaaaaaagatgtattcctcccccttttttcttaattaataaatcttatgtttttatagcagttttaggttcacaggaaaattgaaaggaaaggacagaggtcccatgcacccctgtccccacatgttcacaacactactgacatcccatatcacagtggtacacttgttgtaattgatgaacctctattgacacatcattatcacccaaagtccacagtttctacatcagggctcattctcggtgttgcacattctacgagctttgaaaaatgtataatgacatgtgtccaccattgtagtatcatatagaatagttccactgccctaaaaattctctgtgcccaacctattcatccttccattcctcctaacccctggtgaccacaaatccttttactatctccattgttctgacctttctagaacgtcatacagttggagtcatacagtacataggcttttcagattattttctttcacttagtacggatttagtttccttcatgtctttttgtggcttgatagctgaataatattccactgtctggatgtaccacagtttatccatccactgatggaagacatcttggttgcctcccagtttttggcagttatgaataaaatttctataaaaatcataggcagttctagaggcccctgggcaaagctttgagatctttaacactgtttttcacggttcctccatgttctcttttgcctctgacctgtaactggaagtgctcctcttgggcctgctccatcagcctgcgctcatcttggaagaaagaagcttggtacggtcagtagtacagaatggtcatataccttaaacacactgttacctgaatttaacttagcctatcccgattgacacatataatcaagtccagtgtatcctttttatataaatttgctttaagccagataaacataatctcccagaagagcttatctatgtcacaaaacagacatatatatttcccaaggaagatgctcctcctgcaatcactttctcaaatgcaagcatttgtttttcaacagcactgagcaggaggcctctgcaactagggaaactcaaccgggtcacttttcccacccttccttcatttaataaaaatggcagagtccagttgcggaagatgtgctcagaaagtttgctttcttcatcctgcttttgcctttggccagtttgacccacggtggggtttcttaatttctagcatctcaatttcttgcttaagaaatagtcctatttacctatttcaccatcctctagtgttcactcagtggttatttctttgctacctcaaatgccgagtaatattcaccccaatccatagctggctgacacctattttcggtgatttctgtggtactgattggtgaagatccccttagcttgaaggaaattgaagaagcgactacatagcccataacatcccttttgaattccagcttgcaatttaaataacctggtccttcctagaagcataaaccttcaggattgctcaagtagaaatactgacttttattttgcctcttggtcagacagatctacaccctttgttaaggtatgctcccagaaacgcatgttcttgggctaaacatttacctcatgggagcctaaggagtttctgaatgtctccagaacagtagtttactgtaatggagaagcagtccagcctcattccctccacatctacacatggctttgataccgtaccctctttatttggtctaaaaatatttttaaagaaaaaaagtcacactacaaaggcgattgaggtagttggtttttaatcagttactgatttgttgttgtcacttgttttggttagaaacccttaaaaggagaaattcaactgatggctctcttctcatgaaccgaaagttcaatttcccctgacgaaagtgggtcaagggaaatgaaaccagtttcctcctgattactaggtcataaaaaacggattccagagccagcaatcgccaccagcaacccagatgggtagcccaaagcctgttgaggggcagttggtaggcagcacagcctgagattcatggatagagacctcctgctccacatcattatggtatgttagtggaggagctgctcatatccaggtgggacttctctacctccccttaggaagctgcatgatctgttcacttattgtttgattgggcccttaaaatgtgagtgaaaatacaccagaattttcccatgaaaggttaacaaagttctaggggtcctcattatagaccatttaataatgtattatttattctgaggctgtatccaagtttcagatgctccaagaaaaaaaaggaatttgatcttgtgtcataacacactttaaaaaatgccttcttgaggacaactagttaaaagagagtgctgctaggtctcttcccttggctgatccacctactcaaagtttaaaggctcatataagacaggaagctttataatctactaaactctgtaataactgtacagtctacagtgattgtaggcccatggatttaaacatcattttatatccctaggccaagtcttacttctgagatccagcctcacatttcaaactgtctgcttggcattttctcctgggtgtctcaaagacgctgcaaacttagaatgagcaaaataaaacacttgagtcctgatgcccaattggtcccaaatctagccttctcctttttaggatatggcactcccggccaaccattccaaccagaaatgtaaaagtcatctttgttcccaccctcatgccttatacgtaatccatcagcaagtcatgtgtactgtatttccaagatacataaggaattgatatacattctctgccatcaacttgaactagactttcatcatctaccacttacagcagccctcacgtggttgtcaaattcctacagttggtttctttccagcaaaataaatgatcttcttaagacataaattagattttgtcacttgcatacttgaacaattttgttgattgccttaaaatagaataaataaaataaaacacttaatataaaatcctatctccttaccgcagcctatgaaaactctgtctaccaagacccgtatttatttgcatacctagactcctcttctatcgtactccatgcctctctctctcactatgcttcagccacagccatctttttgtgtttccccatttggtgaacatgccagtctctttcccacgcaagagccttttcacactctctgtactctacctggaatggactctacctctaatttttcagatggttgattctttgtcacatttgggtcccatgtcaaatggtactttcttcaagaggcattccttgaccaatctatttaaaatggcaacccctcccattattctggatctcaaccatagtttgttgatgtagctacaccataatttgtaatgaaattttcatttgtatttgtctgattgcttttgtctctcctgctggcacatgaactctacatctgctttactcttttactcacctggagtctcccttatctagaacagcagtccccaaccctttcggcaccagggactggtttcatggaagacagtttttccacagaccgggggcaggggtggttctgggatgaaactgttccacctcagaacatcaggcattagattctcataagaagcgttcaacctagatccctcgcatgtgcagctcacaacagggtttgcgctcctgtgagaatctaatgccgctgctgatctaacaggaggcggggctcaggtggtaatgctcactcacccatggctcatctccttcctgctgtgcggccaggttcctaactggccagggactggtactgtccatggcagaggggttggggatccctgctctagaacaactaatacgtagaaggtatgtaataaatatttattgaataaatgaatacaaaagtagctatatggctaaacataataaggtgacaagaaagtttctgcatatgtgaagacaaaacagtaaaagaagaaagccaccgtcaggatgactatgagttccatgagccttgaaaaaacgtattcatttactagatgacacggatttcgcttttgctaataagtgggcacaattctaatcagtatcaattatcaaatgtctactgttctttaatcaggaggaaacaagaagctattgaaggtgtgtgagataagaatttaagaataaatttccttttgcttgattcactatttcactgccattttgaaagaacttacttcaaactaagtaattgttcaggtgacaatatttaaacaataacataaaaatccagaaaaatgcacatctacttggaaggattcctttggagaagaatttgggggaaaaaatccccaaaatagaatgcctctaatcactgggtttaatcaatttttggaataattagcctagttaattatttatgaaaacgtaggttttaaatgaaaactacagtttattgttaaaatatatcttctttgtaatacaaattcctatgccagtgtatcagataattaattttaaataggtgggaacaaacctattttcagaaatcaagattttgatgatcacggaaattagtaaggttcttatgccaatagtgatatttttagatctgttttctcttaaagaatttcataaattgctttacagagtttcagttctcgtctattgaaaataaggcatgctcagcctgcacaagtgaacatgagacagctcaggaataccttcattcggccctactgtgctaaattaagccatttggtactgaaagttagtagttacccagaaataaaatcttgctcagaatagtcagaaaatggtgtttgaacaaaggaaacaagtaacagtctttaaaaattacccggacatttcaatgttaactttccagtttctgatttttcagactttcctttgagttttatgcctaattttgaagtgttccaacacaaaacacaagttgtaaaagaaatagcacattgcattgggaattctttacctaagttcacattttcccctattgacatacaaaagaaaaagaaagagaaagtaaaattccaaatgggtattaacttttatgtaatattttctttttcctttttatatccctattactatctctaaaacattggggaggtaagtatcgcttttctctgggtcaaaaaaaatcaagataaacttaatcaaaatcaaatagggggtataaagtaaaatcaagatttttgccttacttttaaaattattatttctagcatctacctcagtacgagggctccgcgtattacctatagccagagactgatggtttcctaacctgggagacctgctgggcatgcagctggttctctgtaaagatcattaacatggttctctgtaaagattcattaacatggaggggtggagacgggtgaaggaaagatgaaatggtgttttctggtaaaagtaaataaacacaatacacatcttttgagagccaaataacatttttccaacctaatgatttttgaatacaagcgtttataacagaatctacttaagtccatacccattaaataataaaactcctaatttgtgagagagaggggacatgctatacagccttgctggaataccagaaagatatataaaaacattcataatcaaacgcccaagtaatgctgaatgcgggagctgcagttaacatgttcctaaaccccacgataaagacaaattcaacatcacttacattctgacactagaccatgggaaaagtgacagagtctacctgaagaagacccagggcctcctcaacccaagaaatatgcaccctgtagaatacaaacatatgaaggagcatccactaacagatattctaactccaccggctgcgggcacagggaaagctagagtaattggctgcagatgtttgaaagatactgttagtcttttccagatggatttgcctctatgacttagtaagagcaaatacaaatttaacattcaatccccagtccgaggaagaaaagtgtaaagaaaggcagagagcagcaaatcgatgaagcttccacatccaaaggatgttcaacaaagacacaaagaccatgattccaaaaggttcattagccccactttgtaaaagaatatgaccaccaggaaatccagcatagaattccacagccactccaatgacacggacagaagcaactctgcagtagaagtgtccttcatgatcatgaggacccagagtttatccaaaatagcaaaattaaagaaagagattgggttattctcacgaattacggttttctgctactctgaagtccaagagataggaaggaaaaagcctttcccaggaatcaaagtacagggaaggtttcccgtagataaaccatgtggagctgagtagtgctgggtattggcgctctctgagaggaagccacatgttcttccctctcaagagcaatttggttggttcacttggaaaggtagaaactcatgctagggcttgggtgaccaaaagaagtacaaaaggaagagcaagagagagaaacctcctatatctttttaccacgtgagccagaaggagggatgagtctcccagacagatggagagggtgagcatgctggagggtagtgtctgtggttcactgaatgaagagcccttggctgggttttgctgacggtttcccaaacccatattgcataatgtgcacaaatttgctctctaagctaattagaatatcatttgtacaataaaatcacagtggagaaagaatgaaacaaagggtaaagctgccatggaatgaaggtgctagagccaaaaggtaacaacatgggctctggagccagacacacctgagttctgatcccagggttactcactagctatgcaaccaaggcagggtgtttaaactctgaggctccatgcctttacttgtcaaacaggcatgataaagtatctccaccatagggtagttgggagaagtaaataaaataaatcacttaaagtcctttgcataatacctagtgtgtagcatgtataacaagttgttgtagtcactattactagtaccagtttcctcaacaaccatgacttaactatgtcattagaaggctatatttccttagtctggcttcagaaagctgattttggttacttgtaactgatataaaagtcagagtaagtactaaaatagatcattttaaattagtatagtctaggtaataacatcttaaacatctgatttattacttctatgtactttgaaaccacactttatatcaaagcacttcttggatcctatgttcatcttctttgaactgattatatccacttgaaattatcagcatgcatttgtatattgtaacagaaatgcaaagtcctcaaatatttttttcctcaggtatgttccttactctttattgcaccttacagagataacaagtattttttttcataagcagtacaagccacaagctaatggagtaaaactgtcctgaatctggaattatttgagctgaaataagtaaatttcaaccattattatgtttttagttgataaaattttaagatacataaggatagactggtaatttttgtagatcaatcttaccatatgttaggaaccagtggtatttacaatttaaattaatcagccggaggtaaagatttcttaaatcatctttttcaggacatttttatctgcctaataagagcagggtttatgagtgaaaaaaaggttttttatagatgattcatcaatatgttattctaatttagtgtgtgcttctatttttaagatgtaatgactttctaaggcataattctaaatagagaatggaggatacaatatgatctattagttaaggggtatgtactcagatgtgtattgtttctgccattaatttttttagaaataccaatgtatatcaaaattaatgttaataaatattcataaaatctttgtatgtgttcagagccacaggccacataaaatcacatgaggagataaggcatatctatgaaaagcaaacagtgaaaaagaacagcatctgtttaagcattttaagtacaaataggcaaacatctaataggaattcctgaaaatcccaatttgtccccattgcttttctgcaggaatacaaaaaaacagactttcataaagcaatttttttcattactagaaatgtgactgttcactttctccagtgaccttagaagttgaagtcaaatacagtgaaaggggaaattacattacagttagcggatatgctatggacataccaactgaaattacacatgcttggtcctgcttgatcctggacaaattgtttaccaactctcagtgtagcagacccgcagtgtctattaacttaatagctattacagaaaatgttttgaaactgatggaagatgattgcgggggatggacgttgaaggcattattgctgctatgaaaagataaatataggagccacttcagaaacacaggaaattggtaaatggagagaaactgttgtccctttgctttcatctgtgttacttaaatcaatactctatgtgtccattaagccaggggtaattcattaaatcacaaacctggaagaatttttagagtttagccatgtaagacaagccaggctattccagatcaagagtgccgtttttttgttttgcttttttttgagacagtgtctcactctgtcgccaggctggagtgccgtggcgtgatctcggctaactgcaacctccgcctccggggtccaagcaattcccctgcctcagcctcccaagtagctgggactacaagcgcgcaccactacgcctggttaattttttttattttagtagagaagggttttcatcatgttggccaggatggtcacgatctcctgaccttgtgatccgcctgccttggcctcccaaagtgctgggattacaggcgtgagccaccgcaccaggcctagacggacccattttaaaaatcattagaaaagatgatttcaaaatatctttttcataactcacttcaatgtcaagttgttaaaaagaaaggatttacttctatgtttaaaaaactattgacaccaagtggaattatctttttttacactggaaatgtttaatctactactaccaacaagaattcctgaaaacaacaagagtaacaaatgatagctactagtgtttcagggtctatttatgtgcatttaccttatattaattacatttatttaaaaaatccttgtaaaataagtattattagaatcccatcttacaggtgatgaaactgagcgtcagaacgcttatctgtccaaaattaaacagctaatgagtagagaaataaaaatgtaaatatagcagcagctgatgtcaagtgttatttttcactattttacaacgtcttaggatacctttttctccatctttcctcagaaatcctttgttgagactgttggggataaagccagcactctcgttcagcacaattaatcccacaggatgtgaagcctactacttttcaattgcaggtgcagaggctggctttctccagagaggcaggtagagaagcaagaggcatagagagagacatctattggaaaaaaatgaagaagaatatccctcacttcatagggggctaaagaacctattctgtaagtgccctgtatttcccaagacctgccttctctccttccatgcataaatacctgtaaagcactgactcacttctatgcttactaagcagcaacctgactcgggaaaaaaagctaggtatgtctagtttcagaagggccctgagagcatcattaataaagccctaaataaaaaaaagtacagggatgtcaacaaatcgaggatctgcagtgacacctgcaccactcttgaaggcagcttcctgcaccacatgttcccccaccccccgccaggcatccacctgcaccacatccccagggcttcctcctgaaccactacccgggacatccacctgcagcacgcccctgagcatctgcctgcactccccatctccccagcagccaagcatggcgttggtgttccctttaggactagaggaaacaaagattctgacaagatgttaacaggtggctgatcaggttgattttctctggggacaaggtgacctgaataattctgtgaaaacattcaagttttgacctaatatgtctcataaaggacaattcctctcctgctgttgttcagaacggaaaaaggacaagctgagttttcaaacctgctgctacagcatctgctaatgggcagatgatgcctgggccactggggccaatccagagaaggaaactgtcaggttggctctttcctgtgtcccatgtatattttcacggatatatgtcactaagtgtaaaggacatgaaataaagactgcaggacatacacagaatgttctttgtggggctctcgggggagcaactggtagacacagcagctgaaaccaaggctcaacctctgtgactgaggaggccaagatgttaagactcttaggacaaagtcagaagttgagaaaataaattcaagagctgatggcatcatatcatggctaactcaacaggcaagaatactgatttgtggtggtgcctgaaaatgtgcatgtataacaacctccactgggtactgcacctgatggctggggttcaccctttaagagctcctgctatagaacaatccactttggcttcaaagtttcaaagatttcctttccctgaattcagcctatcctccctactgaagtttactttttgtaaatacactgcaggtccttattttcacactcaaacacaagtcaactcttctcttccttgggtagtttaaaatatgtcaaaatactccaaattacttagaagtatcagccaaagagtatcaggttgggtaagtcatgcaggaaacaggaaatcaagtgacacactattactaatgtcagcagaggcacttcaaaatggttaatgatcagatccaaagtttcatttatttcagttagaggtggagccaaaccaattcctattatagctcacaacacaaaactcctttgtcaaaacgggttctacaatttttcagttaataatcacagaccctggttggatgaaaggtgtgaaagaagcttaaatcttttaacctcatctttgcattcttaaaattactttctttgcaaaaaccatgctgcttattctgtatagaacaaaaaggccacaactgccagtaaaaacagatccagaacaaaagtaccaggcactacactaggcatgagaaagtattttttttccttctgagttttctgcttataaaatttagaagaattacacttattgtcagactgagaatttagtgatcaagaactagtgatatttaatcattagtgtgtgtcagcagcatctggagatcttctttaaaaagcataatcccgttgatcatagggaagttgatccacttccctatgattaactaaaatgtacctggaaaatgtaggttgaacttttaaaatgcagaaaatataatgtaatttgacccagataatgacaaatctaattatttaactttcattttttaaacttggtattacaataatgctgaatgttatctatgtttgaaaagaaaagccatgtttttagcttaaaatatgccttaacaatttttaaatgataggtaatatttcaccatgcatgctttaaaatacatacaaaaattccgatgacaaagtttccctcccccattgactatattcctgccaaattctaaactatattttaaggctgcaggcagcaagggcccagcaatctatattttaacaagcacctaggtgatttaagcaccacactgaggggacacagacagggagagtaaagtgccagggttccttgagagaaagtagcctcagcacttacacaatccaatagcagggggctactgattacagctttcagagaacactaaaatatatcatcccttttggcgataactgaacttcaccactctttggccaataagtacctaatcagaagtcaatgtcttcatgtaatctagctatgataatattaacactcctttaggacattaagatgcataagaggtcatagttaaactcacatctatattatttataatgtttcatttaatccactaaattttaggaaattacttttaaattggtgaacaaaacaggtttgtcagaaacagatatctctatttatattattaatgttaggaactaaaatataataatctcacacattcacttagcagagtcattttcaaagtaacaaagaaaatgccttatttgctcttcaagaaaactatgggaagcaggccgggaagacatggttaattctattttacagatgagaacgattcagacagggtgaaatgacattttcaaggtcacttggcccatgaacatcagaatcggatctcaaagccaattttttttaacattaggatgttaccattgtagagtattgcttttttaattattaaaaagcactgaattggtaaaaagttgctttgcaaaaagaaaaattagaggaagtaaaaagaagacagtcaaaaggaccattagagtccataatgttatgtctgtagccagcagcaaatggagtctggcttatttttttcaccacatctctcaccaaaatttccctgtctcccaaagcaattatttggaatgcttacaggtcaagccagccttaatggagattgtacagatttatagatgtccttatctccaacaatattgtacactctgaaatctttcacttagtattatattgcaaaagataatggctcaatatatgaattatggtagaactctgaccatgactaatactaggtttaaagatattcttaccatttctttttcttctgaataatattgcaaactaaaggtgtattttctacattaattaatggtaggtattattagttctgatttagaaatgttggcaaaatttaaagttgatatgttataggccctactgctgtttaaaagtgtccattgtaatgtgtgagtggttgctcattaatgtggattgagagcatataatgcttacctgatctataaaccaagtactgaagttccaccaaaaagtccacttccctatgatcaactaaaatatacctggaatatataggttgaatttttaaaattcagaaaatgcaatgtaattttacccacataatgaaaattctacttatttaattttcattttcaaaactcggtattacaataataatgcttaatgttatctatgtttgaaaagaaaataaaagatgtttttagcaaaaaattctccttaacaaaacaatttttaaatgataggcaatatttcgccatgcatgctttaaattacgcacaaaaattctgatgacaaagtttccctcccccattgattatattcctgccaaattataaattatattttaagaaatgttttaataatgcaaatcaaagtcttgttacattttaaaatggagaaatttgttcctatgtgcatgcaaatttttaaataattatttaaaaggctgagattgtcccttggaatggaaatagcttttgattcctttctttctttttattatgttttttcttgccaaactccagttgagtgtccatgggttatttgcaagatctatttgctattctggagaaggtttcacacttaagtaattaggctatgaaatatcaagaagaagaattgggtctcacttatattgtttctccctggctcccttctgcagccctttttcccacttgctcagagagtgtgggaagacagttcctccccaaactatctggtcatcaacctttaaacttcccagtcccagtcaaaagtcctctgccaaattgctctcaggatcagcgcctgcagagataccacatgccagacaccaaagtcacaggacttttgaggaaggaaagtgcaaaaggtgtggtgaagggaagatggtgataaaaatgttccttatccaacagtttgttgtttttataaccatatgagtatttcactgtatatgacttggaaagaatagataactctttaggatattaattaatgaatcagagcaagtgaaatctcatttaatagcattagataactcaaaattcagttctagctgagtttgaaatacattttgatttttttcctgtgaagtcagttttccttcctaataattatttgactgagtttacatttgctgagcacacactagctgctctggagaccgcaagaaaacatggcaaggaagaagttggaataaagcttaaacaacaacaaaatataaatgccacaggtaatagccaaggtagacaataaaagcacagctatcatgagctgacaaaaacatacaatattacataaagatgaaaactaatttactcttacatacattactgggaaatagctttgagggttaaaataaatctaatgaatttgaatggagtctgtattttcttattctacataatttttttctgtatttcttttcaaagtctttcaaaggaaaatgtcaatttaaaaggaaatcctatgaaatcagagattataataatatgaggaaaacgcataaaggccagacaaatacagcaaagtcacagaagactctggcaggacagtaaaatagtcccacatgctagacatgggctgattatgtaaggcacctaatagtttgattttaaaacaaaaataataacaacaaaaaaggcttctccccatgccctcctatgatcttgaaataaatgctaaaaatagaagcaactatatcctactagttctttgagaaaataactaagatagagaataatcgtggtagagaatggtaccttcattgtacggggaaagaacaagaatataagcaactacttaagtttaagtacattcaattacacacagttggaaaagtattcacattcataagtgaggtttcagcacttcagtcagtggttgaaaaagaaaagggatttttcttgcaattataaactataactcaaaattgggtttacatcagcagctagaacactcgcaccaaagcaggagtattaatgccataggtatccctcagggcaatccaaatcagagggcaacgtggtggtccattttccactggtggagaaagcatatatcaatacaacatagatgacagatttacaatacctcctatgtcattttatctggatagtttctggaattcagacactactttgaaacattcataattaattgcaagtgaaaggaagggagaaaaaaaaacatatttccttaactccagcacagtgtcaggaattattcaaagaacaacacaatgagcattttttcaaagtgccattttttttctttctcagcaagtttgccactttctgagaattaaactataaatatacatgtatatgcataatgataaaaatagacagtgagaggggacacaatacgtccctattgttctgaagattgacattttacactcttacacttaatacaaagtggctttcactgtttctcacctaactgacttatcttgtgcgcttagaagactatctcaagacaaagatgggtccagggagttcacttaaaacactagaatcactggtgccaccaacaggggctccaaactagcttcagagaatagacttgctaccgggggaaggttttgactaccagttgtccaagttctttgcgttttgaacaaagaattggacaaaaagtacaaacaaagcaactaaagaacgaaggaatgaaagcacagatctattgatgtgaaagtacactccacaatgtgggcgcaggctcagctcaagagccctggttatggaattttctggggtatttaaaccgtagaggattcccattagttacttggtttacgccctatgtaagtgaaggcgtggcctgcaaccaatcagagacttacgttacaaagttacaccttatgcaaacgtctgattggttgtgagaggggaccaatcagaggctgaagtggttacaaagttattgccctatgcagatgaaaactaggcccaccaccagtctgattggttgtgggagtggaccaatcagaagtagtttccatttttcatctgtgatgcagaaagggaggggagtttgcaaaggcagtaacccctggtcctattgttacttgagcatggaaacttggggttttccttctgatttagttctaggaagtcagcatgaatcagccttaggttccctgcctccagaccctattctcctgcctcaagagaatttaacataaagccttgcagagttgtaagggtgtttttatgcacatattttaatcggtgaaacaactctgtgaggtggggaaggtattatcatgcttcataactgagaacactgaggttaacagaggtttgtgaatgtccaaggtcacactgctaggaaaaggcaagtctctttttgccaggtgggaagagaggcagcgcataagtagatatccttttttagccactaattctctctatacactagaattcgagtaggatattgggagtggttgtgtcagggaatgaattagaggacaaccagcaagccagttagaagagtcctgcaatagtaaatggagagaaagagggactaattgatcttgaaatcgggagaaatcttataagcatgagaactgtataaaatataaaattagtggctttatgagaaagtgcaaactgagacagtgtagtcaaaagctgggtaaatatatttctgcaatgttgactttggttggcaatttgaataaaaagcaatttctgtggtctcttctcactcaaaagaagttgatgattttatgatcattgggagctttccttttaaaattgcactctcctgtcacattaagttagatttttgttagttgctgaaccatgaaatctatttactttatgtaagaaggtggcttactccatgcaattctagccacaaaacaataacagttaagtttaatcccactttagcaatgcaaattttaccaaccagaaaaaataacgggcaaaacacaatttagttaaagggaaaaaaagtagcatttgctgtaaaaaaacaaggtaattggggatgggaagacttttaattctagccacccaaaagtactatttggctgcccaagtttttccctttagagaaagagatgtcatctttacacaggtaaattaaataagttctagctagatgaaagctagataatgaaagagggaatttgaatgtaaactttctggatttagttatctgtacaaaggatatgcttactgatcctcattactgactccacttgcaagtagagtagcagtaacgcaaagcagtcaacagaacctagcattggcattaggcttggctatgctccctaggagctttctgggtctcggcaaatcccttccctcaatcatgtatctaaaagtatctaacaggccgagtgcgctggctcacgcctgtaatcccagcactttgggaggctgaggcggtaggatcacttcaggtcaggagttcaagaccagcctggccaacatggtgatacccagtctctactaaaaacacacaaaaaaattagctgggagtggtggcatgtgtctgtaatcccagctactcggaaggctgaggcaggagaattgcttgaatccaaaagggggaggttgcagtgagccgagattacgccagagtgagactcagtctctaaataaataaataaataaataaataaatatataaataaataagaaaagtatctaacaggcactcaacagacatttattgtccaactctcctgcagcaggtgctatcatacactctgggggtatggagatgaacgtgagttttgtcaaagaatttagagttgagtaagatcatacaaatctgtaatcaagtttgggccttaaagtatttgaggtgttgtgatagatactttgaggtggtagaaggaaagaagaaaaaaagaacagtcaactttacagagaggagaaagggaggcgagtcaggaaaggctccaaagaaaagttattcttgatcagagtcttcccaaaagggtcgatatttatcaggtgcatattcacggtagtggttacaatgctgtgcgtattcgtgtgggtgtgttgcagggggtgggagaacagaggtactatgccagccatagaaaataccataaaaagcacagaactaaaatagtaggcagttcactattgttactacatccaactggaggctaaaatcagcagaaaaaccagggattgaaaaggtttttttataagcataaggccaaaccagaaaccataaatgataaacaaacagaaaaccaaaaaagaatatgtcaaaattacaataagagttgaaaaacaatggcaagatataaacatgacgttggtataagggatatggcatacgagacgtattggcatttgggacagcaaaaggtttatagttgatagaaattgataaaagatgaacaaaccaattaagaatgaacaaaacaaaatgtacaaaattaataatatgtccattataagtctgcgaaaaattcagtctcactactaaggaagaaataaaaattaaagtaataacatatattattcatatattagattggcaaaggtgattcattgttaaaactgtgtatcagccaaagtgtagaaaaatcatatactcaaaagcagaggtaggtatatcactgtcaaataagaatatttctggggttaatttgacaacatctaggaaaacgctctaacctagactagcaattccttctagaatttaagctcaattggcaaatgaaaccattatacacacacacacacacacaaacacacacacacacacacacattgtattttgtagaagccaaaaaataaaaacaacccaaatgtccagcaataggttatttaaataaattataatattatgatatatctactacatggaaactataaaataatttaaaaaatggtaacttagggttttgttttttgataaagaaactagttattataaaatattaggcaagaaaaggtggttactgacagtattccatttttctaagttataaagagaaaaatgatgctgaaaagagaatgatacatgtgactacagttaatttttttatttatttccctcttttgcagtttctataattctttttttccaagtagattaaaatatttggaaaacttcctatgtggaaggcagtaagcagtaatatgctatctgcaaatttgggtatcttacagataatgtgatgttgagaaatagcaaccttttggtcttcttatctctatcacagaattcacaaatcttgaaaataaaatcaacacatttttctttctgaagatagtgagggatataaaattaatatcgatgagagacaacgactttagttatttctgttaaagctttatgcaggttaaagtttaactggttctttgattatcgccattcttacaggagtaagatggtatcgcattgtggttttgatttggatttccctgatcattagtgatgttgataattttttcatgtttgttggcgatttgtatatcttcttttgggaattctctattcatgttcttagcccagtttttgatgggattgatttttttttcttactgatttgtttgaccctctactgggtatctacccagaggaaaaaagaagtccttatttgaaaaaagatacttgcacacgcaagtttgtagcagcacaattcacaatagcaaaattgtggaaccaaaccaatgaccgtcagtcaacgagtggataaaaaaatctctggtatatatataggatggaatactactcagccataaaaaggaatgaattaacagcatttgcaataacctggaagagatcggagactattattctaagtgaagtaactcaggaatggaaaaccaaacatggtatgttctcactgatatgtgggaggtatgctatgaggacacaaaggcataagaatgatacaatagacttcgggtacttgggaagagtgggagaggggcaaaggataaaagacaacaaatatggtgcagtgtatactgcttgggtgatgggtgcaccaggttctcacaaatcttcactaaagaactcactcatgtaaccaagtaccacatgtaccccaataacttatggaaaaataaaaaaattggtagaaaaattcaataagtctagctagattttcaatattaaaatagtcaaaacaatcaaataaagttagcttccatttttaaagtagattctaaataattccaaataatatagcattctgagaattatcagaagcatacatacaggtacatacatataaagtatatatgcatatattaagtatcccatttccaaacattaaaatggaatatgaaagtataaaactatatataacagaactctcatacattgctgatggaagtataaattgcttaaaacattttggaaaactgtttgctataaatggaattacatatacagtatccgctgatccagcaattttattttcagacatacaattccccccaaatatatatatatatatataatcaaaagatggaatcaagaacattcatagcaacaaaagcaatcaaaaaagtttaagatagtgacacaatgagaacaaactattgctatgcacgacaacatcgatggatctcacaattataaccaacaaaagatgctgtcccatgtgacatggtgtaccacagagaatccccacttcaacctgaggtaatcgttttcccagctccaggagttttgcctgctgaaggctcatgcctgacttcctctggcaaaagcagcaaccccccaataagtgggtgatatgggcctgcccttttgcctcaatatgggacatctctggagaacagtccttactccagagcacctcacgggtttggctgaggcctttggtgcaactgcatcttagttcaaattctccctctgaccaacctacttctctcagccccttggagatggtgttgccaagagggctctccaacaaatttttttttcatgcaactctctgagtttcacagtctgtttcctggagaactcaagaaaagagggttggtacaaggaatagtccaaacatcacccaccacacagctaacaatggagacccatcatcagtagagaactgatagcccctgggatgagataatggtacagttattaaaacttttaatggcagaaaatacactggaggatacaacatcatggctgtttgcaaggtttgggtggactcataattacagtaatgggatcagatggctcttgcttagggtatagcgggcagagaaagtcaatgaaaaactgaaagcagcaatttagagcaaagtgaatagatcagagcgagtcaatttctattttccattgctgcataacaaatcacccccaaaactttgtcttaaaataatgccattttattatctttcataatctggaggttgatgggctcagcgaggcagcttttcttctccacgtgagattggctggagtcatctgaaggctccacattctgcaacaaccaatatggttcactcatgcaactggcattggattctggccataggctaggatatcagcttaggattttgactagagcacccagtcctccttcatgtgacctcttcatgttgctcgggcacctaacagcatgatggctgggttccaagaggagaaagagaaatctgccagtcctttaatgggcttggaagtccgagaacataaccatcacttctgccacatttgattgatcacagcctgtcaaaagtccagctcaggttcaaggggagcaaaaaataagctcaatttctggatgcgacatgcttatatagggagaatgtcaggggagttaaagcagggaaggacgtccttatcttgtaagactaactactacagtctccttagtatcgtgtaaagatactcatttcctatagtcagatgcagaataggctgatgataaggctcagggcttaatgatgagggaaactggacatctcagccagccccagcaagtcagctgtgccaaggcctggtcctgtgttagtgaagagggggactgtgagatttgcaatatctcaatggatgcacttgaaaatcgcttatcactagattccccacaacctcctgggcctaaacaagtaccccactccactctgttaaggctatcatctctgcctggcataaacatgatgcagagggctctgccttgcaagatagcaagtgccctcatcaagatatagtcagcttctcctccaggctgccagacaaataactaggtcaggtaacaacataatccagctggataagtgctggctctgctaacagagaagggtgtttacactgaaggagctgtggcacctgcccaacatgcatggctagagctgagaggatgggttcagggtctaggaccaagtatggagaaacataaagtttaataaggaacagcttattgacatgagaacaaccacctgttatataggatttaactcttaaaaaggacaccagaagacagaattcatgttgctaaggtggctctctgaaatttggaggtggcaatggtccaaagcaaggccaacaacagaaaaagaaaaagaaaaacatacagagaagtgaacacgatagagtatagattccaggatacacaaaggccagcaaacccaccaggtccccacactctgtcctggataatacatgatttgccaaagtcctaagaaatgtgctgcctagacatgcacaggcaatgctgcgatgctcagtggtgctgcctttttaggtgatggcagatcggaggggatgctattacagagcgccaagcccatgatattcacaaggaggcagggaaggacatgtctggcatcagggaattcactggggcgtttttgatactccctgcccaactgtgatggagtatggagaagtgccacagcctgagacaggcatggtgttcagatggagatctggatcactttacctcgttatccatctagacaaacagagatgctaacagaggatgtggggaatctagtattggtaggagagaaaggacatgaggaggagcagtgcagcccagagaccagctgctgcagctagggattcattccactccctggaggaactcttccccatgagtttaaatgaagcaagtggatcccaacagcccggcaggtggactatagcacatgcaagtgcacctcctccatcccctctccaagagagagatggtcaaggcctggcccccttgctcatttgtgccatgaagctccgaagtcctgtgtgggcctggataaggactctggggcaactacatctccattcaattcctccttctgacagaacctccctcccctactcccttacgggctattctgccacgagggctccccagtcaacttcttgtttgtcaatctccatctcaggattgaattctaggaaagttaatcttagtcagaaaccaaacacaaaaggacacacacagtataatcattatttccataaagctcaaacataggcagaaataaaatctagtgttaggtattaggacggggtttcctttgtaggaaggcagtggctcaaaggaaagataaaagggtttctggagaaatgataatgttctctttcttatctgggggttactgacatggatataaattctgaaaattcatcaagctgggccatcatgattacagcatggccacactttatttatatactctatacttcaagaaaacggtttttggaaactgatatttcacagtccttcttaacaattcagaaataatttcactttgaggtggcacgaggtcatcaaattaaatatgaatgaccgtccctcatccttaggctctgaatccaacaggctgcattcaatgccagactgagacactgactatgtgaagctggtcaaatcttcaattcagtgaacttagtttcttcatctccaatgtgaatgaaaagtgattactaaataagataatccatttaaagaacatataacattgctaaaatagaatacaaacattcaataatatggcaactatctgcatcaggaaaataagatagagagaaaagtaaatttaaactatttatatgaaatgtcttggaagtgctttgcaaaataaagatgaaattgttttgttttacacataacaatcaataaaagttacttgatagtttagatttggtgtacacagaataattgtatttatatgatgcttagcatataaataagcaatgtcattatgacataatttggtctgttataagaatcatgataagggctgcgcatgctggttcatgcctgtaatcccagcactttggaaggctgagatgggtggatcacttgaagtcaggagttgcagaccagcctggccaacatagtgaaacccaatctctactaaataaatacaaaaattagccaggcatggtggcacacacctgtaatcccagctactcgggaggctgaggcaggagaatcactggaacccggaaggcagaggctgcagtgagccgagatcaagccactgcactccagcctgggcaacagagcaagactctgtcaaaaaaaaaaaaagaatcatgataagtaatgtagtaatatagagactacattctctctcagcaaagtgagaataggtggcaccttcatattgtcaaatgaacatggtttataaaatttgatattcttatatttgaattctgactttgccaattactagcagtgtcaatttgcataagttacttatcttctgaatcttcagtccttaatttctgaaggaagatgatgtgctcattctacaggactttcagtgatattatacaaaacaacattgtgtttaaaacattgggtcaattgaaatatacatatatatatatacacacacacacacatacacatatatatatatataatgactgttgatattagaggaacaatctataatcaatgagtagtttacaaagtgaatttaaatcaaatactgtttctcatactctataaaccttagcacccagagcaaacacttgtataatatattatcagttagtatttttgatggataacacacaaattgtatgaaaatgtaatccacaattgaaaaatgaaaagtatcatgttctggacaactttcttaattagtatcttaaaatctgagtcattgaattgatttggcacatgtgatatgacaatgtttataaaataaaagctacaaaaatattgtggtgtttgtaatattaaaatttattacttgccttataaaataaacattcaaaaaatgaaaaattgttaaatcggtaagacttgcatgcaatgaatcaggttacagatttgtaaagttcattagaacataattcctcatactgaattgccttttaacagtagattcagctcaagtttctaaaaacaaatattaactttttttactataattggttcacttattttctactgttaataaatcagctttgtggaatgtaaatggtataggttttgcacttcagctgatatagattcaaaaattggctctgtcacttactagctttatgtcttgggctaagtttttttactctctgaaccttagtgttttcatctataaaatgggattatcatgtgcctcagaaagtcattgtgaagaacagaaacaatgtcagggaagaatctaacacactgaaatacaactggaattcaataaagacagggtgtttatatcatgatatttgcattattaattatattggtaagtgcctgagaattggttttagtttttcagaacttgtgagtcctctttctctctctccctctcatttgatcgctttgaggtttcacagtagaatataaaactgcagtcctatttattatgtttatgctcttcaataaacacattgcagtatttcaattctggcactagtatcttggcaagcattctggctagaatatattgtatgcttcagaacctaaattgtagtgacatattaatacatcatgaaattcaacaaagattcagtggcctttaaggaagaacaaagaatatgttcacacttcatcatacaatattatctatcctgtcattatttattttcaagcatcctggcaatagtgtcctttgtggatcaattataatagtttcaaattccatagatgagcttataccaaggtcagatgataataggttgctattgagttatgcctatattagaagggattatcaaaattggcacattttattaataacaattttgaattccttttattcatgaaaaataaaggaattacaggttgacctcaaccattttctagttcaagtaagatatgcatcataagacattttagaacaacatacaccatgagcttttaaaaagtattaaagatgtttggttaatgagagagtcagaagtctatgaactacctgtgtatatacaaacctctagaactctaaatgcccaaaggcaaagctcatctaactttctataagatccaataatcttaatatttgtttactgccaaagaggctaagagatgttgttatcagtttttggaagaccaatatgagatgctataggaaatatgcattaatcaaaaagtgctcttgggcttgcctgttttccaacccatcacagacagaatggcatgggggaaagaacacaggctctacagtcagaagacctgggttcaaacacaagttcagacactgactaggttcactttcactcttttatttttctctttcttaagtcctacaaaatgaagtataacaaaactaaactgaactttctgtcactctggggcttgatatatatattcagtagtgtgagggtcagaagtcaggagcatagtgtgtttattccttattgcagtcattctatacccattgaaggaagtcaaccccggtcttgttcagggagtctgtaagatcaaaactatttttgtaatattactaagatgccatttccatttttcactctccctcatgagtttgcagtgggattttccagaggttttatgatgtgtgactgtgacatggcaacccactggttgcagagaatccagctgtgtggtctctgaaatcaggcagtaaacagatttggaaaattataaaacaatcactaaaatatttatcactaaatatattttgttctagaaatagatttaattttcaaaaaatgttttgttaatatataatgggtttattattattttaaaatgaattgataaatattttaaaatatttcggttgtatttctaatacagtaaatatggggttttcaataattgttgagtgtaaacaggtcctgagacagaaacgtttgcttactgctgtctttagtgtaatgatttagtaaaaaataagagttctagagacttctagttttcgctttaaggtaaagaaagctgggaagagatctttctctcacttacaatgaaaagctggagaaactgaaaaatatcataaacctattggagaaagtttaagtaaagtgtccagagtgaagggcaattaacactgcctctcttgggcacaggaaaaaaccaatttcagctgagggaagaaaacagaaaacaaaacaaaacaacttaaccctggggaagatagagaggcagattctgggctgagaactgcagatgggaaggggcaggagaactaaggaagccacacttcaatatcgagggatacactgtctgtctaatagtgtggtgaaatgagaacaacagagaacactccgctgctgccacttctcactgccaagctaagatatcttaagtaatccacagtgctgcttggagagaaacacaagtgtggaaggagaccttctctaaggttcagtgcaaaggaaagacttaaagctggcgatagagcaagcattgagagaaaacaaaacaaaacacgtttgacaacccagcctcaatcctaaaaacaagttgttactagaggaatttgaaacctatggtatactgagtgaaataacaattataacacacttcacacctaacccaactcctaactagttttactcaaacccctgcactaaaggcccagcagagggaaaggcatgtccactactaggcagaaaaaactgttaacttcagtttccattgaactacagaaggtgtccaattttcaacagcaataaaaacataaagtatatagaaaggcaaaaagtaaaaaacagaaaccaccaacacactcccaacagacaaagtaagcagcaaaaccagactcaactatgacacagatgttggaagtaactgataaggaatttaaaataactatgatgaaaatgttaaaggatttaactgaaaagaaggatatgataaaagatcaggttggaagtttagcagaaagccagaaactataaaaaaatcaaatgaaaatgttagaactgaatacaaccactgtaacagagacgaagaatgctttcacagcttcattagtagactcaacatagttgaagaaagaatcaaggaatttgaagatagatcaatagaaactactcaaatagaaatatatagagaaaaatgtttggaaaaaatgcagcagagtatccaagagaggtgaaaaaatatcaaatggtctaactgacatgtaaatagaataacagaaagagaagagaaacaacagggcagaacaaacatttgaagaaatcatggctgtgaatttttaaaaattaaagacaaacaccaaactacagagccaaaaacaaaacaaaaaaaaaacctcagagagcgcaaagcatgatagataaaaagcaaacaaaatccacccaggtatatcatattcaaactgctaaaaacaaaggacaaagaggaaatcttggaggcaactatagaaaaagatacattacatgctgaagaacaaagataagaactatagcagacttgtagctagaagacaatggagtgctaaaaaaaatgtgaattcagaaaatattttgaagtgtttttcaaaaatgaagaagtaatatgtattagtctgttttcatgctgtttataaagacacacccaagactgggcaaattacaaaagaaagaagtttatttaaaaccatcagatctcgtgagacccatttactatcatgagaacagcacgggaaagacccacccccatgatgcaatcatctcccactgggtccctcccacaacacgtgggaattatgggagctacaagatgagatttgggtgggtacacagtgccaaaccatatcataataacaaagaaaaactgaaataattaattgccagcagacctacccttcaaaaagtggtaaaggaagttctataggcagaaagaatatgatagcaaacaggaacttcaatctacacaaagaaataaagagtgctgaaaatagaatcaatgaatggaaaataaatttttttcatattttaattgtgctaaaatataactgactctctaaagccaaaatggtaccaacatattgtatgtttgtagcatatttcaatgttaaatttatgaaaataataagataaaggatgggagggaaattcagattatttaaggtccttacataatgcatgcagtgggattataatatttgtaggtagactctacttgatatttattgcaaatcacagagcaaacactaaaaaaattaacaaaattgagtaaataatatagggaaaaatagaaacataaaaatgctaaatttttacaagaagtaagtaaaagagaaaagaaacaaacaacaggtaagacaaatagaaaacagctaacatagaaggccaaaaaaatcaaaacccaagtatatgctgtccacaagaaacacactttacatatgtacagacaggtcaaatagatacagacagcttaaaaataagtagatggaagaagttaaagcatggaaacactaacccaagaaagcaagggtagctatgctaataggtaaagtagacttcaggatgagaaatattatcagtgataaataaggatactatgtcttgcaaaaagagtcaattctctaagaagacataacaattctaaatatgtaccctagagctttaaaagatgtaaagcaaaatctgataaaaatgaaaacaaacaaatctgcatttatagttagagacttcaacacttttctctcataattgacagaacaagtacatagtaaatcagtaaggatatagaacacccgagcaatattatcaaccaactcagcataattcacatttatagaccactcctcccaacaacagcagaatacacaatcttttccattggacatgaaacattcaaccaaaatagactggctatattctggcttataaaaatctcttaacattttaaaataatataaagtcaagttcctactttatctttcgtttctacttatagttctctctctctttctcctcacctcagtggtcagtcaatgggtccctgagcattgggctccatcattgactctgtcctcacctaagttttctcactaggaagacctcatccatacccaaggatttagttattgctatgcactgataaatctcagattcataattttgcctaatatcacactactggactgtagactactagacagttgctctctggatagtttattggcacctcaaacccaacatactattgctaaattcaacatcttgttccacttccttaattacctaccgtggtgattcatatttccctccattaagatatttaagccagaattgtgcatcttatcatttatcacctccacatgaaatcaaccatgaggcattattgataaggtacccttagtatctctctttccactccgtctgttatacatgatgatacatatatatctgatgattcttgagaatttggttcagagatttttcccttgaaactattattagtatcttcaaaaacagtgaagtctgtatagcactgtattaaattcctggagctgctgtaacaaattatcacaaaccaggtgtcttaaaataacagaaagttatactctccctcttcttgaggccagaagtctgaaccaaggtgttggtagaaccatgctccctcagaaggcttttggggagaatcctttccttgccttttccagctctggtggctgtcagtattccttggcttgtagccacatctctctctctctctgctctgtcttcacttcaccttctcctctatgcatctacctcaaaactccctcaatctttcaactctaaggatacatgcaattacacttaaggcccacacagagaatctagtatagtccagtgtaaacctcttttcaagatcattaatttaatcacatctttgccatataaggtaatgttcactcttgccgtacgagttgctattgacaagttccaggattaggacatgaacatgtcttttaggggattactattcagcctactacaagcactctgtcatatatttaaaataacatccacagttcacaagactatggagttaaagaggattcatacacgtttgaaaaaatttaaattagcatgatgtcttcagagaacatttggcaaagtcaagcaaaagtcttggaaaaaatgtgcatattgcctttatagttttttagtttttatttttattttttgggggatggagtctcactctgtcacctaggctggagtgcagtagcgggatcttggctcactgcaacctccgcctcctaggttcaagcaactctcctgcctcagcctcccgagtagctgggattataggcacccgccaccatcacattcagctaatttttttgtagttctagtagagacaggatttcaccacgttggccaggctggtttcgaactcctgacctcaagcaatctgcctgtgtcagcctcccaaagtgctaggattacaggtgtgagccaccatgcctggcctgcatattgcctttagcacagcaatgacaatttcagaactctagcataaaaatatttggttcatatgtgaatgtgcaagtgtgttcaccgcagtcttttttatttgaaaagaaaggttgaatctagtataaaatgcccaataataggggcttacctgaggcttaatttataatatatatataaacaagtgtatatataaaaatatatgtacgcacatgtagtatatttatacaatgacatgatgtgtagccattaaatttggtaatataatgccatgtttactgacatataaaataattcaccatattgtcaaatgaaaagtttataaaatggtatgtgtagtataataacattttagtaaaaatatgtatttaaaacaatctggataaattgatcccaaaaatattaatactggaattgtatccaactcatttttacctatgggtttaaatgttgtgcagtgagtttatttacaatattttaaaataactaaaaagtgaatatatttgttaaacacatattaatttttcttcaaagtacatttataattcttaaaacttcagacatttcaatgtaatttagatatgaattgtcttctgataaagaaaaaactatatagaaatatataaaaataaatttgaaatatttatttcctaaacatcacaaagtccaaacatcgaagaaatgtgaaccaccttagcaaaaatattaatactagcattatccatgtattgtcctaacaaatgggagaaaatcttttatttctgaatgtaacaaactttcattatatttaagaaaaagcgagcctacagttgtcagtatactctatgagccatttaaaagccaattatgcatgcctggtaaagtaaatgagaccatgaatgaataacatccacaaacgtaaattatacacataaattataaaatttaaatgtttctggaagaggcactaaccttaacataatgattagcataatgattagtgctgctgtccacaaaatacgtcttccaagatatttttatttatatatacctcacaaaataatgatattttatatactactactagaaagtaacttttgtagctcaaacctaaaaaaattcccatgaaattgttatttcactatcattaaatgggatctaccaattcttcccaaagcaataaatattcagtttctctggtatttgcttcttcacctggaaaatggattaatcaaaaaatgtcctgttagagttttatggagaattttatgtagctcttcataaaataaacaatgaaaattgtgcagtgctcacaggcagaacatctgcattaatattaaggtgagaaatggcacacaattaatttaacaactatgaaattgattaggttgttaaaattttcgtaattcactgtatgactctctctttgcctactaagtgcacggcatttcacatcaaattacagaaatagttttcctaaatggttgttgtaggttggaattttcaacattttacaacaaagtatagtaaatgattcaactttgttagaattataaataatctaaaagaaatttttcaagatttatgttttatcaacagaatttgctagattattctaacatctgatagaaaactagggttgatatgtcattaccacctgtcactgagagaatgcagtgctcctcttctaacacatacctaattatgagagaactgtttcaattctgccaactcacagacttctttaaaggttgcctaccccaggacaacatatatagacatcctgggaatggtgatacacctcccatatcctgggagcatgagacactagttaagtggaaagtgcccaggaatttaaaaaaaaaaaaaaaaaaaaagtcaggcacgttggctcccgcctgtaatcccagcactttgggaggcttaggcgggtagatcatgaggtcaggagttcaagaccagcctgaactacatggtgaaactccatctctactaaaaatacaaaaattagccaggcgtggtggcatgcacctgtaatcccagctactcaggcggctgaggcaggagaatcacttgaagctggaggtggaggttgcagtgagccgagatcatgccactgcactttagcctgggcaacagagcgagactccatcttaaaaaaaaatttttttaacaattcctggggaagtatagggcaaagaatatgaagtcatatgaatttactgggcatagtggaagttggcaaagagtcctaaaaggatgcagtcagatctttgaatattaaatagggaactaagcaaacttttctcctttttagtttacttgactcctgataagcaactgtgttaacagcatgcaaattcttaatttcaatttgcagaaagctaaaagatttacattttccagaattcacctcctctatttctgatttttacaccatcctcctagttttattattaagaaaatcttttactataagtttaaatttatgtatacttgatgtaaagataatacaagctggccagtcattgagataaggggaccattaatactttcaaggataaaattagtcatttatatcacagtctcttaaaattcgtttttctttaaaaccatctgggaatgccttcaaactgtgaccaaactgttctctgtgggattctgatttaattcatggcatatctgaaagagaaaagttattaatcacaaattggaaaagataaaagcagtagtttggttgaagtacttatttcttagtcatgatttttttctttttgtttttgaggggagaggaaattgcgaatacaagagatggtcaaattgactactaaatttgcaccttattcttcatttacttcacaaaaccaatttattgctaaatttccctagcagcatccatctaacatttactgcattgtttattccactgaaagaaacttcttttaaatctaaaatataattacttccacctatccatttactccaacacatatttactgcctagtatatacaaaaatctttgcaagaatccagggagatgcaacataaccacgcattccttggtggggcggggggcggggcgctaaaatttgatttttattttctttcctttttcattgttgtcatttcttgaagctcaaaatctagaaaaaatatttcaaaaccaaaaaaaattgttataaaatggttccacaaatcatcactataagagtttagctgactcatatttcagcaaagcaacatactttacattattttgaaatccaactgtaaaactaactgtttaatatttggccactttggtctgaagttggatactggtgactaaccatgttcatgcttttatttgaggtaaacttgaactcaggctccaactgtcctcctgttgatgtgagggtgaaggaaggtgccacgtccacttcccagggactggcgtagtggtacagtcatgatgacaggacacactgaacacaaacctgcaaatggaactgaatctgtgccaaggacacttccatatctgcctaaagacccagagtttagtcagttccccggacaggaatatgatattgatttcaagaatgcagaaaacaacttccctctatttttcagcctgaaattcttattcattcacacattccaacatttattgaatacctgctattgtctagatgttatgataggtgctaaggacaatgcagtgatcaaaatagacatggccagcaccttcatggaatttaaactacaggatagactgaggggaggttagaaagaaagaggacaacccttctccctacttctctccccctgcaactcccccaatatgaccatatcttagtggttttagagttactttcataaagtcattcattaaagtttctctctttcccactgaatttgattgcatgatagtaaattccttgagggcaggaatcctatagcataataggttgtacatcctcttctaacagccaattgcctagtgattcacattgtgcaggctttttttttctgcaaaatggataaagtcacattcacttccaggaaaagcaatagcaaaaggaagttatgacacccagaacactataaaaacacagtgaaaggcaaaagataaaagttctccatagagcagcatggctgtgtggtagtgatgtagttctgtttcagcgttcagacattccatgtgcacaagagctgctgatcctttcttgtagccctgctaccctaacccccatctccacacccttagtgcatgtagaaaatcagtatggcctgatttgaggccacgatagaagaagatatcttccccttaaaaagttctccccaaatggtcttgataaaggattgtcttattcatgctctgaattaaagtccagaatgccttctcttaaatacaaatgctggcggtgactgcttgtgcttttgaattcttgtactaccagatttattgatttagaaggtctatcttgttcagaaaggatttcaagaggataaaacatgtgtcatattgataaggaggtagagaatagtgttaagaatggtgggtcaggagccagacatcttgcctttgcaccaccttgctatttgtttcacaagttactccctgtatgactatgacaattctgtgcctcagtttccataaaatgtggacaagaatattactacactataggttattctaagaggtaagtgaaaatacatctaacacacgaagtatcatctgcctagaacaaaatacgatctcagcaaatgctagatattattaaattattgttttcctcttataaatgaattatctcaattagacctgaaatcacgtaaaaccaataaaatgagattgggtcccttcaagaataccaagtaaaaatggtttgaagggacataactgtaatgaaggagaaaatatattaggttaaataataaacatatgaagtgactttggttaagaagatcaactattgagatataattatgaacttactaatgttaaaggcattatagattttgaattagtagaaatagaatgccttgccataatggattttggaaactgtagtttgtttggtgtgatatatgaagatgcatgaaaactaagaaagaaaactttcagagtttttatcatcttgtaaacataagaacaaggtgagccacagacacagtcggagattaattaaccaaatggagcagagagactgttcccgtgtggtagtgatatcatattgagcaaagccacatgcagaagtgaagaataaatggggacagagcaacctagcagatggggtaagtccaccttgggagaaggttggaggtggagttgggaggggagttatgcaataaacaaaggatgggacttggagggataccttagctctattgaatatgtgagtctgggatcttgaattatgcaaattcaccagcattagtaaaacagaagtttgggaatccacatcttctcagttctctaccgggcctcctaatgcaacgaaggaaccttagattggaagagcttgttcttcagggaggttttgtaaattggcatggcaactagcaaatctcagaacctgaaatttagattgagtcccttgctgccatcaaagatagtagaacgcactcaaagacagtagggagtaggagagacaaatcaacaaaggcagtgcccgggcctggtcaatccagcctcagacagaaaaccatttgctgtctgtcatccattattttgagatactctgggatggccacaggtttgaattgtaagtcatggggaaaatgctgagttctgagtagatcacaagataaatgtggttgccaaatgttatcatttttgattactgataggtgactgtccagagctcacagtttttatgggaaaaataatgcttaaagtgacctcattgtgtcaatgctcactgtgttattgcaaaatcatttcagaatacaaagatggtctttactgtcaagcctggatgtaaattgttcagatctctgatcaaagaaggtatgtattaaatttcacttaactttgggcactcactggatctttaccaaaagatgttccacttctctgagtttattcatctatttttggtaacaagattttatagcaaagctgcttgatacagtttaaatctgggtccccccctcaaatctcatgtcaaattgtaatctccagtgttggtggtggggcctggtgggaggtgagtggatcatgggggcagtttctcctgaatggtttaccaccacgcgccttggtcttgtcatcaagataatgcattaccagagatctagtgtttaaaagtgtgtagctggggccaggtatggtggctcacgcctgtaatcccagcactttgggaggccaaggcggacggatcacttgaggccagaagttcgagaccagctatggcctacacggcaaaaccccgtctctactaaaaatacaaaaattagctgggcatggtggcgcacacctgtaatcccagctacttgggaggctgagccatgagaaatgcttgaacctgggaggcgaaggttgcagcgaaccgagatcacatcactgcactccagcctgggggacagagtgagactctgttttaaaaaaagtgtgtagcacctcccccgtctctctcttggtcctgcttctgtcacataagacacctgctcccactttgcctcccaccatgagtaaaagtttcctgaggcctctccagaggcagatgttgccatgcttcctgtacagctgtggaaccatgagccaattcaacctcttttcttcataaattacccagtctcaggtatttcttcataacagtgagaaaactgactaatacactgcttctatttgtttcagtggagggtgaaagtggggttctagggtttctaaaattcttccaccacattaaaatagaaaatgagccttaacaaatcagatcccatgggggcagaaaacaatctataatgtaagccgggagaggccatgccacgtcactagtgtcaggaaatgtcatataattagcacagccagggcatttgtcaaccaaggatctaaaaggatttttcaaattgtgaaaatctcaaaacagtcctaagagttactgtgttattacctctataatacctttgcaatgaaatctatttaggtcagtatatgaaattctatgagtcatttatatataaaggcaatttctctttcactctattctcttccaggatgagttagaacagcaggatataatgaataactatcaataaattgaacttcatttaattaattcgacattatcatttaatattaataaacataaaggtattattgctgaatttatcaacagccaccacttggaaggtgtgaaaatacccagccaataacaaaagcattacagattttctttatgtaaaatgcattatgtttttctcattcattttttataaagtgaacatttataaagtattttgatttttgcatgttcttataacattgtacatgcatttcttacagaaaaaatattggactccaaatcacaataaaaataacttttcaatgctattatccactggccagattggtaaaaattaagaagcctggtgacactaagtgttggcaaggatttaggacactggggatgcttctttaccacttgtgtgagtctaaactggcaataccacgtagcaaaacagctgctcatgatcttgtaaagctggcactttgcatagcctggcctcttgcacgtatttatcatgaaacaggcataaagacatatgtggcagcccagttgataatagaaaaaaaaagccaggaaatcttccaacaaaccaaatacacaaaaatgagggaataaatggatgaacaaattgtggaatagtcataaactgtaattagtacaacactgaaaatatgatcagtgtgcatcagtatgcatagatcttcaaaacaatattaaatgaaaaaaagcaagtggcagaagaatataaacattttgctgccattttcataaaatttgaaagcaagcaaaatccaacaaaaagaacgactttaggaataatgcatgtaatggtaaaacgacacagaaaagtgaaagaaagacaacaaagtaaatttcaagagaaacattcatcatggaggacaggagggcgctgagattaggaagcagagagcacatggggtatttcaatgttgctgatgatgttctatctgcagatggatggtgtggttagggtatttgttgagttgttatgtcttctatcataagtagacatggaagtttaatatattttttaaacacatcaccttaaacttaaatattacctttaaggatgtatagtttatagctaaaaagcgatattcacttcccccaaattaaaagttctagatcccagtttttatacagtcattaatagttttgtgaccttggacatgttacttaatctctctggggatattctttttccaatctgaaaatacagattctttgataggaaatcccttaggtcttttctggtaaatagtcttgtgtgtctgtgtgtgtgtgtgtgtgtgtgtgtgtgtgtgtgtgtgtctgtgattcaaatgttttcttttgattgttttttcttttcccgcagttttattgaggtataattcaccagtaaaacctgtatacatttatgtgagagtgagggtctgagctgctggtcctccacttgatgtaggggaggctgatggcaactgttgtggtatggccaagcctggattcctgggaccagcacttgccaaggctgagggactggggtgaatgtaatccctgtgatcagctgccattaggaatttaaacctactctcagaagtgtacagcagaactaaagaagagaaacaaccaagagtcatctgaaattgtgattggctcattaataatccaaggtcaatgacagagatcattgctcaagcatgttttcctatggctcctatgaagacgattgctctgcaggcttaggctgagtatgttgtggaatggactgtgaaggaccggtgtggcttccttacaatagcgactttgtctcctacttcacggctcctaacatgtgccctgttgtcctggaaactggccaagatgattgaggctagggaaaaggtgcaaaagaagaaacaaaatgtcaagaaaatattgctgaagctaatgattcaaaaaggacaaacggaatgagaaggctctgtaacaagagacaaaccatttggaaaattctgcagttttgaaaggacccactaagatctcttctttggatttcatgatactgtggtgtcatttaatacacaaagtctcgccatatgggaaaattatattggttctgaccttagtactgcagtaacttttagacttgggtataaacacttgttggtgtttgttggaagttattgtaaattagcatttattatcctacaaagattttataactgacttagtcatttcccattttgcatcttatgtactgaaatgaaaatatcctgcagataaaaatgacttcagtcaataaactctattcaaataatggtttaaaacgggatcctcttctggacaaaggtaattaagaatgtaatagtcaaaaccatcctctttgaggtgaaaaatatgctttggcttaaaagacaccatatgttaatcacatcttttatcattattgcttatttttcggaatagaatcattctggctttctcaaggcaactcatattattaatgagtacttctattttctgtactttttctgattttcacctttgagattactggtaatgatcaagacactctgaatttttaacctagttttacaaagagttctcttattagattggctatgtagaatcccacctgctggatataacaatttttgtattgatgaacactgccattttcttcgagataacttgttgagaacagtgccacttgcagtaaagatgtcaggcacactgcaatgttttagaaccagtttatttttgtgctaaacagaaatgtgaaatagtttaaatgtcttatcaaataatttgctgattgtatagatacaacttccgtttttttattccagtctttgttttaactcatgtggtggtgtcttatactttttgatcaactagattcaacgtgaaagttaaaatctcaaatttcttttagaaaacacttaaagggcaatagtcaagtcatactttataagtggtgaggaaaagcttaaactttgcaagaattttgttgggcatggtagtaattggctaaaatgggtaaattatgttgaaatgagaatgtgcaattattagaagtaaggagctgaaggatatttccttcagttaagtagtgtaactgaaacgttttactattaaacataggttttataaatgcatcatccagttattttattcactggcagtatctgatatttgttaatgttttccccacctctgatattaaattttaaattacaaaaaaaactgtccaatagctctaattttaaaaggaaactagatattgaaataaatttttttaaaaattatatatatttacagtgcacaagttgatgttttgatatatgtgtccactgtaaaatgatacagtcaagctaacacatccatcacctcacatagtgtgtgtgtgtgtgtgtgtgtgtgtgtgtgtgtgtggtgagaatatttaagatctactttcttaaagtatacattattattaactatagtcacaatgctgtacaatagatctccagaatttattcatcctgtctaactgaatctttgcactcttaatcaacacctccctattgcactcccctctctatgcccctcaccagctctaaggaatattcttataattctataaagatctaagccttcttccatagacaaagtccagtctacttgaattcagttctcccaaacaggccctcgagaagttacttaagtgtacaatcagttcatataggtctttttaaaaaaaacactaagttatttaactataccacaacattaatttcctttcctttcctgagttctgccaccctaggatataaatttttcagcagccacataaagtggagggcccctctggggattcagcagagccagctggagatttttttccccatacagttcaagccgagatttgactttaaaatcaaagtggcacgtggtattacgcagtcaaaataatatgggactgaatactagaagcctattcctaatcatggcctcacattaaggagttagttggataactggggctaagtcatttaatttctgtgagtctcaatttattcatctgtaataaggtgccagaaagggactaatgctctttgggaacattttctcttccagcttactataattctacctaatttaagtttactgttgagggctgtttgacataatgatcaactattttaaaaagtgttcaattatctcgtagaaatcagttaccaaaaccaaacttctaaaaaccacttagctctaccaggaatttttgttttttgaagaagttagagggagtgtgtccatacactgatggatacacatttaaaaatcctctaattcacttgttcatctaatgttaacatagtaggcactgttatagtcagtgcagacatagctgccctcatggacctcacactcttgcatgaataaggagaacctatcctgaaagactaatgatgggttgagagcaaagacatgcttatcactttgactcatttactctctaatctcatcaccagaaccttaatgcattttatctgttagagatttcagggcataagacctatgcaaatatatgtgactgtcatctatttattcttcagtcatttccagaatatgctagtatcacaatgtggataggctctaaaagagaaagctctgccaaaaaaaatcagtgattcattgctgcgtaaggaataaaatcaaactctttagtttatgtgctgaagctcctctgtgggctcctctgtgattcacatctggtcacacaccctacattccagccatcacaaattcctcatggtaatccaaatagctcagccctttcagttactcacttagcccttcagcttgaacctgggtataaacttctccttcaaaagccaacccaaaaggtatccctttcctaaagacttctccaacctgttttctattttatgaattaaaacctcttccttacaccgaaaatattgcatccctatacaacagcatttttttttactgctttatatcatagactctcatctacatacacctcccccgaaaaaatgctattccccatctgaattcttgaccatagcatctttgagcacaatgaaatgtgttgtagcgtcccctaagtgtggcaatgattggttaactgattggttatacaatacagagataactgatacactaacttctccttccccttgccttattttttaggttctgcacctggttttctgaacttttttccctaaaccctggttctccttgaatctgctcaaattctaaaaacagcctgcacgttactctctttcttcccctgtgctgcaaggctgccagcacccagtttgtacactgtgagtcttacatacttcctgttggttctagcattaccttcttgtgttcccaactctcaactcctctggaggaggaatgcttcctctgctggtcctgcaagaggctggttcttctcaaccaagtcacagagaaatcagcagggtgacaaaatgttgcaatacattgtaaggagtacccatgagatattgctggaacccagaggaggtggtatgtaaatctcagggaaactgtaggaatcctcaagctgtccttgaacaatgtttagaggtctgccatgcagaaaaggaagtaaggacatcccaaggaaaggaaataagagcgggaagacagagagagaaacatcataaaacaccgtgttatttaggaaatgacaaacaagcataaaacctcatgatgtagaggagtattaagagttaaggctggaaaattatacttgaccaggtcatgagagactttaaatggcacactacaaacttgaaacttcatctgacaggtcatggagggctagacatgaaatgatttaatttgggaacttagcaaaattaaacctttcaaaatgatttatataatgtaacttcagagaatagtttggaggaggataaaattgaacatggaatgagaagtaaggaggctcttggatttgcagggaaaagagatgatgcaggtatcacgtaccagagaatcccgagttgtggacaggaagcttatctgagagaaaggtaggcagttagtcagtaaaatttgatgttttgatacaaggaagtaaaagtgtaggctgccttttaagtttcttgcttgagcaactataaggatgatgtatatgaaacagaaaatatagtcacataaaaatactgacatcaaattctgagtaatggaaaggtattatggaaagatgaaaagaaaaggaagaggagtcaagaaaggtaattcctagaattgcagaaaacaatatagaagggggaagagaggggaaacggaaatagaaagttaaaatggtaacaaaggaggcagcagcattcagctgtatctcaatctccacaccgatggagggagggcactgatgtaaaatcaccatgatttagctgcatccataatttaactctggaaagagttttggtatatttgaatgcaattgctccagatgttctacataactctttaatcacagtaataaaaccactctgcaaaaatgtaattctggagagataaaagctgcccaacttctgaattctttctttcacttccctcttccaacatatgaaaagtttaaactgcaaaacattcaaagccaggttagcatcatgtcacacatataggagctggatgggaccaggaaagagaggacaggctgtaaatgcacagagagctgaggcgggcttagggactcaaacctaagcagatgcgcacacaggtgtcacaaattagacaagtaggtagttaaaggacaatagactgcaggaaaagtgatgagaactatcagcaaagaagctcaaaacatgcaagatggttttggtggtaaggagaaagttagaagctcagagaaacagtttcaaaggtagggaaggttagaaaatatccagggaagcgatctggaaagcagataaacatggtcatattagggagatactggtaatgatttcttgctttaggcagtgatcttttatgtttcttttttcttttttttctcatgcaaagaaacaattccaaagcatgattgtctgggaccagcaggcaaagatgtataaatataagtgcctgtctggagacaggaacctaaaagccagtggttctgaaactttagtgcacatcttaatcacctgaaggcttgttaaaatcctatttctgggccccgaccaccaaagtttctgattcagtatttccaaactagggcctgagaatatacatttctaacaaattcccaggtgatgcgatgttgctggtccagaacccatactttgggaaccacattagtcatcggttcttatccctaaatggacactaaaatcataggacatgctttataaacacattcatgcctgagcccactctagagatggatactgaggtggtctagaaagggtcctgagatctacacttttttaaagttctctagatgattcaatacatagctgaggttcaaattacagaattgaacttcaaattaattaacttcaaatagaattgaagttaaatgttgacgggtaagttccttcttggattcagcaagacatcttcctgaaggtgaaccagctattctctcgacacctaggggttaatatttttcattggtgtctaacagtgattatgcttatcaaaaacacattacttacagctcctgctaagctagactcaaacaaagtcctatttatgccaataaagtatttgggtaatatcactgatgatttataaattttcctagaaggtttaatttaccttgaagaaacaaagaagaaatctctaacaatagaaggaagactatggttttctccatccatgctgccaggacttagaagaaaaacaattttcccaaaacaacaataaagcagccaaggggaaaatccaataaagtttctgaggaatgacagtgctccaggaacagatgggttgattaatttctgaaattttatgaagaatattggctgactgaaacattgacagagatttttaatgcaactttagagataagaaaaataatcaataaagcctcacaacatactagccaagtggaacacctgaatgcaggcatgatgtttttatcttttttgcatttttcagaattgttaaataattgatcaattaacaataactaatggaatacagttgtccctcaatatccataagggagtagttctaggacctcctgtagataccaaaactcgaggatgcccaagtctctggtataaaatggtatggtatttgcatataacttacactttaaataatctccaggctaattataatacccaatataatgtaaatgttatctaaatagttgttacactgcgttgtttagggaatgatgacaagaaaaaaaagtttgtccatgttcagtacagatgcaaatttgtttttgaatatttccatttgtggatggctgaatctatggatgcagaaaccatggatacagaaggctgactgtacattatgctggtataatcttggttttgtttactaatctttctcttgtataataaatatggtttaaaagattatatgcaaacctggcatttctacttgcttcttataatctctgaattgtccacttaatacagttggagggttatattaaggtagggaaataggaattaacatataaagacaaatagtaattaacatatataggaattaacttataacatatagtaaatatggtttaaaagattttatgtgaaactggcatttctacttgcttcttataatctctgaattgtccacttaatatagttggaggttatgttaaggtagagaaacagaattaacatagaaaaggcatttattctttatactagggctaattttgtcatcaaaaatggactgtccacatcagaaaaaccttagcgcctccacagagctttggaagatttatgtaacacctcccatggggcccagtggtgtcacttgtatacttattatgacatattgccaaattttgcttacatactggtccttccatgacccaggatcaaacatggtgcatggcgaataaggaatcaacaaatgttgtgaagtactagactgatgttatcatctgatgggtcctacattattttaactttttggaaaattatctggctatgccacatttcagaatggtgtgaacccgggaggtggagcttgcagtgagccgagattgcgccactgcactccagcctgggtgacagagcgagactccatctcaaaaaaaaaaaaaaaaaaaaaaagaaatctcatctcatatgcccacatttttcaactgaaagcaactgtttaaatctctcatgccccctcctagagcctcatcttgtacccctagccccactccactatccccattcatttcttcatcacttttattaaccaccctccccaagagcatattcctagtccccctgagaaacacagtttatcttcagcttcatttgttacacttactccttaatgtaggttacaaaaacacactcgaacctccttgacaggcatcctagcattttgaaatttacctgattcctagcctgctcatcatcacagacataacatttataaactcattccactccagtgtttatttcatatattgctgaaatctccatgaaacgcctctctcatgggaaacttagttcaaagaatattagtgttttaaaggaagctcaaaatcacatgatgacccctgtcaattgatatatgggtaaactgagaccctgagggaggagcacgttatatgctacaaaacactgtggctagcaatgtcacgttaggaagaggaggaactttgtgcaaactggctacaatccactgaatgcctccttcctgccttgatgttcctttgacatcgctggtccccgccccaaaggagagactgacctgctgaggtgagtcacctgctcaggcccatcacagcaccccgtggcctctcagcatcctgctgcccccctgggtttaatcctacccatccttctttctcactagcccatgagttccctgtcatggggattttgccatttctattagtgagttccaagcccttttcaggagatgatatatttgtagaactcagacttcaaaccaaacctttaaatccagctccttcaacaaataatcatttaaaactttaagttaaaacatgcctagttgttattataagcaagaaattaagccattgagctttgttatttcatattcattctttagacaaatatttattaagaagttctatgctaaacagggtgctgagaaagagaataatggggacaggttgaattcctttacaaagggtgatcaagagcagcattatgctgggtgcagtggctcatgcctgtaatcccagaattttgggaagcaaaggcaggaggattgctagaggccaggagttcaagaccagcctgggcaacatagtatgaccttgtctccacaaaaaaataaaaataaactagccaggcatggtggcacacacctgtagttccaaactactcaggaggctgaggcaggaggactgcttgaggaaaagggttcaaggttatggtaagccatgatcacaccactgtattccagcctgggagatggagtgagattttgtctgtaaaaaattttaaaaaaagaaaaaaatggccgggcgcagtggctcacgcctgtaatctcagcactttgggagactgaggcgggcagatcacaaggtcaggagatcgagaccatcctggctaacacggtgaaaccccgtagctctactaaaaatacaaaaaattagccaggcgtggtggcaggtgcctgttgtctcagctactcgggaggctgaggcaggagactggcgtgaacccgggaggcagagcttgcagtgagccgagatcacaccagtgcactccagcctgggtgacagagtgagactccgtcaccaaaaaaaaaaaaaaaaaaaaaaaatagagagagagaaaaataagtgccagcaataagaaagaatcatttatgtcaagaggactggggagttatgaggggtcaaatttccaggcagatggaataaaatattttagaaaatattacttatcattcatcttatatgattgtgatgtgatgtactcaatctcaattatagaatgactaatagaatattttgactcactttcaatacatgtatataaaaattatttttacatgtccaatataaataaattgattttcagtatgggacatttgtggatttaacagtggttaaacctttggccatctatttcctatctttgactaattaatgctttactatcggtacattacttttactagtatctgtctagaactttcactaagtttatatccttcctaagtcaattaaacattcaaatttggggggaggtcaagaacataaggtaattcagaaccaaacaaaagtgccagaaataacctatatagacacacgagaagaaagatataagccatttcacttataaaatgtgtcatctgtgtgacagctaggacattataaaggacactcactattcaatcagttttacatgtgtctaatcttcatttcagcttttgttaatttacatgaaccaaatatcctcaaccaatatttatttacagaaggcagggatgcttacatatttaacgtgcctctttcttgaacaattaaggttaaaaccaaaaatatagcaacactctagtattctgtggactgactcaaacattttgctttgagctaagggtacaacaatgttgatttaacaatgtctacttaaatagactgaaggttttactttcatcggcctgaattgcaaagaattataagaggcaatgagaactttctttcaggtatatctcacaaggatattctaacatctttttttaccccttgctattaaagttcttgtctgagcggcaccaaagccaggcttgttcattgcgttctctaaattgtgtccttattgcagacctcatctgtgtttgtgcttctttctctttgaggtatctgttcatttatgctttcaaatagattactcaatgggcagcagggagctgaggtttctctagcagtgacagatcgtttcttggaaagaagagactgattctctccagggcaagcagatggtcacacccctagaaggttccacagagattcacctctgtcatgcaaaatttctctgacaagtgggaagagaaaggtgggaaaaggaaggtaaggcaaagacaattcttattccctttgtttaagatgtcatcaaaatagcctgcatcctggaagaactcattgaagtaggcactagtaaaaatcatggtaaaactcaaaaataaaaggacacatggtgatttcttaataccgcaggcattctagaacaaagcagctttgccttcagactaaaaggttgtgattttagcagaagcaattttatttctattgcatctccacatgtaagacgtatggcaacagtaggaaagaattacggaaaaaataagagaagtgacacttcaagaatttccaaataatcaccttctgggacagctaggctgtgaagtgaaataaaaccagaggagggtatatcttgcatgctactagagatacatttctgacagttatcaattcggcaatacaacaatttatttgatttccatttcactctacgattctcggatgccaaccaattgtcaggcactgggttaggcatcagcagaatatagagcctagcgctaacagaccttcgttcaattatcagctccacccatggtaggtctgtggtctgagaacatattctgtaaaccatcatatcacttttttgtttgtttgttcttttgagacagaatctcactctgtcgcccaggctggagtgcagtggcgcgatctcagctcactgaaacctccatctcctgggttcaagcaattcttctgcctcagtctcccaagtagctgggattacaggcgcacgccaccatgccgggatatttttttattattattatttttagtagaaagagggtttcaccatattggccaggctggtctcaaactcctgacttcatgatccgcccacctcggcctcccaaagtgctgggattacaggcgtgagccactttgcccagccctgaaatcactttctacataggatgagcatgaggttaaaatgagattatttacataatgtgcctagtgtatactaagcactcaaaaaaatatactcactattatttattactactagcatcattattacagaaatacaagtttgtagaaaatacgccctatgctacaattaataacctagtgggagatcaaaatacagtaacaggtatctataatgcaacgcagtagattacctggggttacatagatgtgtagagtactagacatatagactagatatactgactactattaaaacagaaaggacaaagaatgagaaagtggtaaaagtagcttcacacctcttttcaaaacctaaagctagaatatttctgctgaaggtttgaatttaaaaagaaaaaaaagttaatgtcctcatataccaggaatctatcagagcacagtaattcaatcctcctgatctggttctatttttatttatagctgttattcctttctaacactctaaaagaaacgcattatgtttattatctctattttctccgactgggacgtatgctccatggctccacaagggcatgcctttgtcttctgttgatgttcttgctcggggctgaactcaaagcacctagaatagtgcttggcacatagtagtcattcaataaatcggttttggttgaacaaataagtgaaggaatgaatgaatggattgacaatggccattctccaatagcggacatcttcagaatgtgaaatacatagaaaaatttgtcaaaaactgccaaagttgaaaagaatacatttctgtctataactcctaacttaatgaaatctgatttataaatagtctacatatcttggttctcaatgcagaacataaggataactgaacagaaggacaactgaactatcctttccttcctttgttccagtagtcaaataaagggaagtttacataaatgtagctacttagcaattattagtggccatgaataagctctgtttgctcccacttcccctcaccagttctgttcctggatcaaggcacactcatgcaggaggagctgctgatggctgagcatcatctagcaccaaccattggcagagccagggagttctgtttctgcagcagaagggatggcatgtgttcctggttaaaatttagaattcattttttcataaatatagggtcctaaacatggttttcattagagtaatactatttagtttacagaaaatgggtcaaaagactctagaagtcattaagttagaagccagtcactaccgtgtagcacaatttccatgggaaaatactgttcagtgtccaaacgtattcagttaacaaatacacctttggaacacaacctatctgtaaattggtattgccgatatttaaattgtattaagtgtgtgtttatcagctctcttcggagcaactcaagtcactttagatatgccaatatggctacccaaaagggatccgtaagaaaataaagacatgagaaaaagctttctgtcttttattctaggttttaaacctaaaccacaagatgtgaaatactgtgttaccgtaacaataaagaaaactacaaaacccaaattacttggatataactgcccagaaacctttcccttagtgaaaaccagtggaatgttcccacctaatcaatcagtaaagtgttccagttatgttttgcacatgtgctcagctactgatcccttcttctaaggaaagaaactgggttaaccgaacacacacaatagagaggcagaagataagccccagatggcagagaaggtgaatgcaattggaagacaggtgcactccacctgccggtgtgcagctaacttagagcccactgtgaccacgagggagacgctcctctttaaggatcagggcatgactgcttttcagtgttgcctcttcatttttttccccatatcccatctcaccttaagaaatatgtattctgagcacagtaaattaaaacttacattttgaatgttgctatagatgcactgaattgtttcatgagaatatcttctcatcaacacaattaaatcttccttggggagagagtcatgattttgacttcctttgtaatctcctcacagcatatggtgccatatcaggcaggactgggctgagggactatgagcctctactcattataggaacagcacatacagcctacatgcagtgcaatactgagagctgtatcctgcatgagtacaaagtccaggttgctcagtaaatatcagctattcttaaacttgttcagcaagttgctgtcagtgtcatcaaatgaatgataaaggaacatgaaataataagacagggatttttcagcagcagcagaaaaatatatcatgactagacaagtaatttttaaattctttacttggtagtactttgatgtaaaaagatggttggcagatcggtttttgcagaaaaaaaatatacagtatggttaatagcacttactaattgctcaccatgaacccaactttgaactagatacttcacataaggtgactcatttaagcctttcaaaaactttgatatgtaagacgaattatccttatttttcagatgagaaaactggactcagtaaaattaatttgtccaaagtcgtctagctagttagatgaatcatgatagtagaatctggattgtgaaggcagtaacacttcccatctggaacacagaagcaactactagtatcatgaatctgttgactatcttccaacaggtaactccttaattagcacctcaaatgttatcatttcataaattcgagtttaatattttccaagttgcttatgggctatgtccaatatcatctcaaaaatcaatataaccaaaatatagctcaattactacaaatcagttccctattccaaatgcttagatgttccagtaatgtcactactcccaatatctttacactccaaatctctattcaccctattccctctctaataactaattaccaatcatctttttttttttattatactttaagttttagggtacatgtgcaccttatgcaggttagttacatacgtatacatgtgccatgctggtgcgctgcacccactaactcgtcatctagcattaggtatatctcccaatgctatccctcccccctccccccaccccaccacagtccccagagtatgatattccccttcctgtgtccatgtgatctcaatgttcaattcccacctatgagtgagaatatgcggtgtttggttttttgttcttgcgatagtttactgagaatgatgatttccaatttcatccatgccaatcatcaagaaagcagctgctaccccttgaaaagtcactctactagctactgggctcaagcctatgagacatgcaaaaaacatcagctaattcactacttaaaagagcttaaaatctcagaatattcacataaaatgttaaaaatgtgaatattataataaagtaagtaatccagataaatgcaactggaattcagagaagagtttaccctcagctgagtagtcataaaatgtgtgctgtgagaggtgagatttggctgggccttgaaggatacaaaggacattaaaacaattattttaaaagaaatccttcctcctggtaaaacagtcaactagatagaaggacagaaagggaaagaaaacccctgaggctccttgtcctagtctctaggagcagccactgttaacaattcatcaagtagatggagcttgagtacatgcaaataaacaaagaggaaaaatagctggaacagcagagccctgacaaacaggagtggtcatggtggaggctgatgcaagagattattaggaaatgagggtaagcaatgatgagaaccaattgtgtcttcacacactcgtcccactgacacatctgaaggccaaccacgttctaggcatactcgggtctggagtaggcaggggaatactagcgaatgggattgttgctcttttggggggctccaggacaaagtttgaggagtttcatgatgacctcaagagcattttagaaaagtaaattttgatgtgagtttaatcagatcctagagattagacatcccattaagaagctgctatgtattccaggcataaaatgatgaagttgtgaagtcaagcagcagcagcagcagcagcagcagaactcatacagtacaaccaccttgctctctaacgtaatgagtaagaaattaagactaagagaagatgggtgttttgcctaaatttagaatgtaattaaaggctttataaaataactatggatataaaagtcttgaagaactaaataataatatctttgtcatttcagaattggaaaacatttctcaaacatatcttattggtaccataaagagaatttaaaatgcaactattttaaatttaaacataatcttttcatccagagacatcataaaaatgagaagacaagccaccaactgagtggagataactgaaatgcctattacagaacaaaactctggtatccagaatatataaacagctcttacaaatcaataagtttaacaaaaagaagtaggagagtggggaacatgtatgaataaggaatccacagcaactagaatattaataaagagagggaataaatcatcaacattaccaggagacatggaagaacaaattaaaactacaatgagatatcatttcatatccataagattggccaaaaataaaatgtatcaccaagtgttgacaaggatataaaacaaaaggtgttcttatagattgctgttgggatcataaataggtacaaccatttttggtaatttgcattatctgctagatgtgaagatacgactattaccctactgcaatccccctccaccctaatcagagtcccctttgttagcacaaggtgatgtacacgtgaatgttcacatcagccttatttggaaacatcttaaatgtccatcaacaaagattgatacctttatcatgatacagttctacaatggaataccatatatcagtaaaaatgaataaatcagatctacatgtcatcaaaatactgaacaattacagtaaggtaaagaagactacaagagcattattactacttataaatagtctaaaaaagcaaaacaagactatattgcttaggtacacatacatacatagcaaagaataaggaaatgcatgcataagaacaataaacacaaaactcagtgggctgagtccctctgagggaagacatgaagagtacactgaagtctcaacagtgtatgcaatgatttatttcaccatctgggtggtggacacaaaggggtttataatattatttaatttttggtgttcctgaaatatttcacaggaatttttaatgaataataaagaattaaaaagaatgtgtgacacaggtacagagtaaaagagaaaggaaagagtcaaatattgcttgaaaatttttcaaaatatttactcccatttctacttccctggacttgattcccaataatgtaagcctcactaaaacagcctcttcatgcttctctctgtcccagtctggtgttagacccatctactcctatcagtccaagaggccacttcttcacgtcactgcctattcagaatctgtcagtggttcctatcaaatctaaacattcttgtatagccattaatgaccctctcaatcaaattcatcttcaggtctaattaaagtggaggaactggaggagagaaccatcttctggaccaggaacatgccaagttcatttgcacctccacgtctatgcaaatgttttctctatctgaaagtcggtccttcttcctatgtaagtcttacaaatccatgaaaatctagcttcagatcttccctattggaagcattccaaaatgatctcattctctgttgagcccctactcctacagaaaagcccaaaataagtacatttgagcaccagtttcattctgtaacccattattactaattatttcctacattttaatcgtattctttgtattacatttcaagctacccaaggagtttaactaggtcttgctcttctatattcttcacagtaataagtacccaggagatgttacaaatattttttgtttgcccatacttggaaaggctggatatatacctaccaaaatacctgacatctatcatcaagatcccttaggattcatatcatcaaagcagagtgttttcaattatctataaagcacatgcaaatctagaggaattattatgcaccatagtttataaaaacatggtgcatgttcgcattctgtctcaccattcctcacaggccattcgaagctgaatggtagatgtggtatctacagcagggtgccacatggaaggttaacatatccccaaggctggcccacctcaccacatcattccagtagttcagaagcagatagtagaacagaatacactacatgtctggccagaaacaaaactagtataaaaaattcatgaaaatacctagaaggctgtgattccacatcagtaaagatgttagattccagtctcccctgtgagagccaacccacatctacgtacctacatagagatcagcctcaagcaagaaaggcagttgtagctgcttctctgcctcccacaacactttccacctcatccctgtgatctgatttattctttgagtccttggtgaacttttgctttcttccacttacaaaccacataggggccactgtctctggtctcccttgagcttctggtctcctagagggagacaggcatatacgcagaaaatgaaaaacaaaactaggttataattacgtatcagactcaatggagacacaaaaaggagaactcaatgtaagaggtgaggggtaggaaagaagtttatgctaagccttaaagggtcagaataaagtaagacaattaatctactaatatgttaattttgaataagaaggaggaggaagaagagggaacaggagtttgttttttctttgcttcctttttaaaatccttattgtatttcaaaaccttacctctgcttgccagcagagtgcatgttgcctagttgggaaatgtagcactgcgtagcccatcaccttatattcaggctgggatcagctcagtgtttaccaggtattaacagagtaaacttaggaccaaagaacacagcatctgacattgcaaagaagtgccatgcaaaagctgtgtaacaccatcctcagagttatggcccttatgcactaagaatacagatgtgcattcacttgtttattcattcactcaaccaatgtttacccaccatttattaagtgccaggtgctgtgctaggcatcagtgatatttggtgaacattctatatttagttcttgatctcacggaatgcacagttcagtggggaaagcaatctgacactcacaagtcaacacatcattattgaccgtaaaaggaccatgaaaaaggaataaagtgctaaaacagcattcagctggagaccttccctgattaaatgacttttcagctgaagtccaggaaagagggaacaatgtaagaaacagcattccaaggagagggggaaagatttcttagcctgctccatagaagctctagaatcaagtgagtcttatctgaactacctaggcaaggattcacaggaaagacttccaaatgcattaccacttcaagattcccctgctgaccctcccaaactctaaacggaaagcacatcctaatttgaaaggatgaaaaggtgactttgccttctgggttaatgtctacacgaaaatagctttgaagagagtgaatgtgccttgtctttttgctagtatagtatgatgaatcatatcaaagaatggttgtttgcaaagtctgagacaagatcaaaatgccattttcctctgaaactgcagcatgtgttttgtaaagaaatcttagtgatatctagcagggaaatttgcagtccagaaatagactccacactgatttctactgaaattgaaaccaagaaagaaggggtatccagggaaagggtgtaatcatgaggttagaatgagggttagtgccagtcctcctatcacatactcagatgttctccagtagtagaattaaaacagcaagttactctagcagatgttttcaaattagctaaaaccgtgtcaccagagtaaagcagcaaagctggaaatgtgcccagagagaccttcccacaagccgcctgagggagccatttaaatgtctctgagccctcctagtgcagagattcagatgcaaggctagggagataagcaagtcacagcacaatgtctcctcatccaaatgcttatccatggcttcagtaagaccacaactctgctgaatattaagaaaacctggcaagattgagcagttccaaatcacacactttgtggtttgctgttgtgctgttgcttacaaatctgataagaaaacattgagagaagacagagaaattgtcaatggcaacagatgagcaaaccatgataagtgaatatgaaaatgaacagtttggttgctggcaaatcctagggagagggaggaaggtggtttgcatcttcataacatattcagaacactgatatctagttcacaattagatatccagtgggacaatcacatcccagctatgctggttgtctatccaagaaaaagtccaaggatctgagccaaatatctgtggatatagatccacagggcttccttttgcatgagctggttttcctaagtgggatgttacttgctgcccagtaatcattaactcctataggagggagaaaataataaagcaaccaggaaaaatcttaagtcaataatggatgaagataaccctgtttctcacttatacaacagctatctgtcccctaccatttactagagagaaggatgggaaatggttgggtcaacacggctcctgtgcaataccaacctctgtacaatcagactaaagaacagaagacctcaaagggatgtcattcacctttttaactgccttataatcacacctcatttttttcttgttctcaatcacatgttttgctctgtaggtgtgtgtttggcagggttacagggaaaggtgtagcaaatatacagtatacagcattgtataagctaaatagttacatcttagaagcaaaagaactggtacctggtatctcatacaatcggttatctgtgggtgtctaatagattaaaatgaatgtcagaagactatttctaaatcctcctctgtggtaatgcaatgttttagatcttcctaggaacagcatctttggcaattcctgatagaccacacaactagagaaagtcaccttcatcgggcagtaacaagaatcgagctacaaattctcatgcttcggaaaaaagaaagaaaaaacatcttttgagggacactgtagttattcctctctgaaaatagagaactagtagcacttaggatcttaggaaataaaacagctcaagatatgggatgtttttgaacattcaggtgtttcaacaacaacataaagatttttctacaatgctagcaaagtatctttttgtgatagtgtttctttaaaataaaaaaaatgtacaaaagaccaacataccacagacataggcatagattataactatgagaagtgaggattggggaaacgtgtttaggtttttcaagagtctttttagccttcttatttcaatggtgttcctgtaccaggggaaatataattaccaatggaaaaagagaaaataaacaaaataacctaaaattgtatcattttcttaatttaagaaaagagaggtaagtgtgatttctatagagatgaaatctacataaaagtagattttaattggatgcttcctgagaggaaaccaatttcctctcctctgataaacagtggagcaatttgtgggaatggtcatgaaggtaacatgaatttgagctgatcatagaaatttcactatagaaatacacattagataacattttactattatctctgaatttgaaatattacgagatcagaatcaaaacactgaattctttgtttctgaaagagttgatgttcaaagaatatggtattcatctcgattaagttgtagatgaaactattactttgctgcatattagtgaatattgctcatattcactaaaatgagtactttgtaaaacaagtccccctcttccaagttttaattttatatttaaaaaaaatcaatctaaatggctatatggaacaaaggcacacatatttaatagagttaactcaaagtgcatgcagtttctattcccaaattgggttgaataggacacttaagcttagaaggatttaaaaagtagaacactacaattagttttaggctatttctctatatgcgctacataatattttggaaggaaggtcttgtctccatttgctttcactaatcgctaatatgcttttactgggtttttagtcctggcagaacaaagcttatgttgatggagaaattaaagatgctaaaccatgaaaattccctcctagggaaaactcatatactcattatttccccaaagcacaattgcttgtgtgagatttaagaagccttgtcagaaaattattttgacatatttaaaagaatgttaaccagttccttttgcccatatttatattgcctgtaatgtttgagataaagtattgtatttgcagactaatcttagaatgaaatatagagaaatagatagctataaatttaaaaaaatctatgtatgcaagtacattcttctttactcacacaaggtaactaacattttctcttaagtaaattagttttttaaaaattcacagaattttatatctgcgactaggggtattgcaaggcactaaccaactgaaacaactttacatttaagtactaaatctaaaggaaattaagaacagggctactgacacctgacttctatgaactttcttgtttcatgccagagtatgaattttctgaaccaagggtagcgtttataacttaaactttttaaaatcatacattttgcatagacatattcattatttctttataggcttgaatttccttttaaaaacttaaagaaaactttatattcttctggcatgaaataaattaggatcttgtaaaatttcttgcctccatgtcatttccgttcaagttttattcaaggaataaaaagtattgctttatatgcaaaatgacctaggccaatagaaagtcgtttcctgaactgaaatcgtgctataaataacagtcaaagggctgttctttttagaacagctctttcagggtaaaaaataatttgcaggatgtttgccttaggacctaaaatcgctttcctagttctcagcatttctcatctccatgtctaaccacatcttagactgatctatcctcaccttctacgaagccattcacgaagaccacaaaagctaaaagatctgtctttaattggtacttttattatatgtctttcctcgtaattccctaacttcacgtgttatggaaggaggcagggagcattcacctcccacgaccgggagtcagtctctgtgtcaggagtaaggagtgaagagtctcgcctggatccacaaaagacgtgacatctcccacccagcgtcccactgcttgccgcctggctacctttaaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaagtgcaatgtgttatctcgcccagcccagaggagaggtccctgtttggccttggttccagcccggctcattcaattcgctgaatgtcgggtctcccggcccgccccgcgattctccgggaattggccttggccgcgggcagggggcgactctccagtgacctcctccttggaccccatttctctctctctctctctctctgtgcctgtctttgtgtctctgtttctttggctttctcttacaaacgcacgggggagttggtccttttccacaatgccaaaatgtcacccaaaaagctagtgcaacaacttgctttgcaaacgacccaggagcctgccgagaaagccctgcggggagcagccccctcctcccctgcaaggtgcatcgggggtggggtgggggtgcgaatttgaccggtggacatgaccgggacaggggaccggtgttctcctcccctcccccttccgggaccctgtcgcaattagaaatccttcccctgcctgggtccccgtggggagccgcgaggaccgcatggccggagaggacgcgctcgcccccgagatcccaggttacccggagggcccgggagtgcaccccgggcggctgaaagggtaaggagcgcggactctcgagccagcggccgggggagcccagcccgcagcccctccgcgggcgagggaagcggcgaccgcgcggcaggcagcagccaggagccacccagcgcgccgcgaccgccgccgccgcgcacgccccagccccgcggcgcagcccggcgttacctggccgcgtcccgcagtccggccctcgctggctgcgtccgtccgttggtcccacgagcctcggaggaaggagagagatgtccccgcgaccaggaccggctctcagcgaggtgacgggaaggactcgagagaggagccgaggcggcggcggccgttcgcgccgcctatgctgccgattccccgaggcggaaggtgtccgcgaggccgtgtcctggagattgcggcgcccgaagcgcagcgctcgcctctggagcggaggct

SEQ ID NO: 249 - DNA, 343216 bp, Homo sapiens
tatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactcccatgaccatgctgatatgttatgaatatctctttttgttataactaggcctttttgtcttccattcctttgcataaagaatattacccattcaactagggaagtggttgtataaattatagtacaggaatataatggaatactttgccattgttaaaaagagtgtggttaacccacaagcatttatataaaacaatgtttaagacctaatttcaagtgaaaagagcaaattgtagaacagtatgtataaagaaagtttagacatgggtatatataatatatgcttagaacatttctgaaaagattcataagaaacagaattcttacctctatggagggctaaaaagggaatgaagaggggagggggactttaacacattattaaaatatttcttggtggtgttaaaatttttatgagtattatattttgtaataataaaaaaggaaatcttcccattatttctaaataaaaaagagacatgtgggtatggtgtatattggagaatggcgtatcactacggcaagcaagacaaaataatagcagcagcaacaaggagatctgacctgtggtattaggctgtttttgggtcactagaaagaaatacttgaagctgggtaatttataaagaaaagggttttaatcagctcatgattctgcagggtttataggaagcacggtgctggtagctgcttctggtgagtcttcaggaagcttacaatcatggctgaagatgacagggtgtcagcatgacacacggtgagagcaagggagcaagagggtggggaggtgccacactcttgaacaaccagatcttgcgtgaactcaaagtgagaacccagtcgtgttgatgaggacggcaccaagccattcattagggatccgcccccaagacccaaacaccttccaccaggccccacctccaacactggggattacatttcaacatgggatttggaggggacaaacacccaaactataccacctgtccttggttggcttttgatttttggtgtccttatttatctgtgtaacttcgtatatcagccctttccggtaccatcctaatctctgcttctaccattctttccctgcagcagtacaactttctcttgtctcttacttgatttcaaactgtctccaatttgtctctctctatctcatctagaggcaggctagtatagtggttgataacatgggctctgaattcaaatcccgactgtgacacttctagctctgtgaccttggaaagtcaattaaatttatgtgccccagtttcctccttgtataacctagttaataatgattcttgtcttataggtactattagttattatgtgaattgtgtctggcacagaggaagtgcttctaagtgttagtcattactattcttcaaggtgattttttggggggttaaaattagatatatttcaacaagaaaaacaaataaagaagccaaaagaaaaaagtaagagaaaagcacaagaaatgcagcaaaaaccacccagaaagcctcttcacgagaagaatgactgctgagatgttagaagatatccttccatacatatatactcatgtaaataatatagaatatactttcatctaaataagaaaaaaaatctctcttgtaattggctttttgactccacgccacgcaggccatctgtgtttttgtttgtttgtttgtttgtttgtttgtttttttgagatggagtcttgctctgtcacccaggctggagtgcagtggcgtgatcttggctcactgtaacctctgcctcccaggttcaagtgattattctgcctcagcctcccaagtagctgggactacaggtgtgtgccaccatgcctggctaatttttgtatttttagtagagatggggtttcaccatattggccaggctggtcttgaactcctgactttgtgatccgcccgcctcggcctcccaaagtgttgggattacaggcatgagccaccgaccccgccacgcaggccatctttctaaaacaacacttacatcacttcattatctggctcggctatcagtggtttcctattgctcactttattaaaacaaaatgaattctctggatatgtaaggatcttacttagaaaagtcctcactttctatccaaagatggcttcccatttttaaatactcttctaatacatcagtcagcttaatttctttatactcagacaaaattcctcctccgtagtctgttgcctctcagtgattattcagattccaaatcgaatcctttctctttcatgaagtcatcccttcctattttcaattcctattagtttttcttttttttggacaaatatagcacttttagttagcggtaacatacataatgtaatttcaaaacttacaaataatgatacaaaattgttttcattgctcttggcggcactgaatcgtatatgtgcagtggagacagagccttatagctctcttgtctccctcagggcatttagcagcttgaaaactttgattcctctggaaagaagtcttggttgagagtgagatgacttgggtcctaaaccttgctgaagagcttaagcgaggcacctctttacttggggcctccatatcctcatttgcaatataaaagggttggaatcatctttgaggatccttttagttttgcttctaagattttttattcattctctctctgaagaaaggctacctaaaaataatgccattggtaaagtggtaaatgtttagaaactgactttttgggaggaagaagctctgcctcgtagagcgtgtcgatttccatggtgtaaatatttccatcacggccaatatcaggctcccaggatgacaaaactgaatatggagttgggaagagatgtccaccattggctctcattggacgactggaccccccctagcattgtggagtggctcctttcaatgaagaaatgcagcctcaggctagatgagcacagccagctagcttcgtctccagcttctctcactctaaaactccaacacaatctttcttcactgagtggagaaggcgacgacaatggaaagtgctcccagcttggcttttcaaacccaggctctgaaggcacaaaccccaggaggaggccagtcttctcaggcacttgtacccacagcagtgtccatctcttttggaatctggcacaggaatgatgctaccgaggtggtggcaattttatatgcagttggtaatttggatctgttccgagagctctcagctctgccttttctgggaaagaggtgtggtccaaagaactaaaagaaggttctgagctgtaagtcaagaacaatgtacagatggtggaaacagtctccagactgttcagggaaaagtcctcagagtttcatgagtcagtgggaggaaagaagttggagagaaagtagagggctggagccgaagacccaggctctgcctcgtgaggctcacaaccatgagaaagccttggtgtatcagtaaagtgttggttaaaaatcaactcgaaattccttctgacaccgttgggaggatcttatcatatgtactaaaaacatttgatgactgttatttatacttatttatgttaaacaataggaagaaaattaaaatattactagctatcaggatagatgatattttctcttcattggtttatgtaggttcatatatatatatatatatatatatatatatatatatatatatatataattttttttgagacagtctggctctgtcggccaggctagggtacagtggcaagatcttggttcactgcaacctctgcctcccgagttcaagtgactcagcctcctgagtagctgggatcacaggcgcacgccaccacacccagctaatgtttgtatttttagtagaaatggggttttgccatattggtcaggctggtcttgagctcctggcctcaagtgatctgcctgccctggcctcccaaagtgctgggattacaggcatgggccaccaagcccagccacagataatttttaaagaatgttgcagtagttaatgtgatcattgaagaacacccttcccaacttcaaaaggactagttaatgctggtgctccctgccccctcatagaactagaaggaactgggattccccagatgaactgaaggaaatacgctaatattcaaagtggataacaatactagggatggctgcgtggatatttttaacatgctaatgtgtacctgccagactgagctcccagcctccaggtgggctggcaatgcaaagtagggttgagaaggaacagggagcttttcagagaaccacagattcagaagcagagggagggggaagaattgaagagaacacagacgcagtgaaaggatgctgggcagatgttagatggcagctcaactcaaccactgcgcattaaagttactcatggagggtactgttcagggcactttaggcatagagggattgtgtaatgatgcgttagcatttgttcaacatcccctctgggatgacgactctgtgccaagtgcttcaaaaacattctttcagatagcattgaatctcttcctacacgagggacagagaaaataaaccagtgcttaagaaagctatattaccttgagaaatgttaacacagtgcttcgggaattcttaggaggaagaaataatggctgacagccagaggttaaatttgagaagaagatttaaaagaatggagactttcttctcatcttctcccccattagatcgcaagttctgttgtactgggaatcctgactactataatatatcccaatgcttagcacatagtaggtggccaaaactgataataatgatggcgatagctaacatatgtggagcaactactgtgtgccagggactgtgctaagtgcgccacatacactgcaccttctcgaatctgcataattacccttgaacaaccagtggcttgttgaagtggcgtgatgttacttcccatacaagtgttctgtgcttgtaagggaatagcaggaaagaagatctcaaaggagaatggtgtcttactgtgacacttttgaatgttacatttggaactttgtgcctagacaacatgggattcagagataattttttagcaacctggtagaaagtcttagagaaggagttggagcagagagaggctgggggcgtcaatacaaattggtccattgcaatcactcaagtgaaaaatagtaaagctggaagaggtaagaggtgagttgcaaagtttcaagactgtatttaaaaaatggtcattccactgatagaaagggaagtgtcaggaagagaagtgatatatttagggagtactgtgttatgtgggtgctttgaaatctcttcttcctgaatgctgagcttgaaaatacaggatcaatgcacatgatcagacgatggtgcagatcttatgctaaagtcttagactctttaggctgtaaagatcttatatagatattttgtctgtcttgctcaggcagaattatcaaaggtctcagaggaatataactcagcttgtttcaaaagaggccttggaagttttctctaacaatttccaaattaattgatgtgataattaataactttgcacttagaagttcctccttgcagctaacctgaattccttgggctgcaattttgatctcatttcctcctggtttatagataggaatgttgatgatgttgctatttcaaatgcatcttctgtaaagatacatttatttaggacttacacccagcttgcttctaaaaaggattagaggcagctcctaatatgtccacctaggcttccttttaaagaagcttttctcattcctgcaaaatgtcttccatctgcatgcataagaagaatttctttaataataaatgatacagcaaaagtaaagctaataacgaactatgctgacaaaatagtaacctgtaaacaaaacaaaacaaaaacaaaaagaaacaaaaaaccacaatcctttcttatgccaggcaatgcagatttttctcatcagaaaataattttgaccaaaactatcaattttaacaccgccagcctctgaattttaagttcctttcttctttgtagtgcctgcttttgccattcttagactcgtgtgtgtgtatgtgtctgtgtgtatttttctcttccacttgactctggaaaaccagattttagtaaagcatttagtgaatattgaaaccaaggtataaatgatggacacagtacttaaattattaaaggtaccaaatgtttgttgcatgaataaatgagtgagtgagtgattgcatgaatataatttgtgattgtaattagggtgttctctttacctcgttgtctgcactttaacgggaacatagatattaaattgaataaatggcaggtggcagacagaaaagacgaaggaattttgaggctctctgcaaagagaagccgtcctggaaggacagtgggcagcatctctgatcagcactacctaaaggaagtgaggagtctttgttgccagaaaccttagccagggccttccctgctcccctccctctgctgtcttagggctttgtttacacagccccttgaagccagctgtcaagggtgcaaacctggtctgccatcctttgaagaaggttcaggttacacatggtaagccacagaacagagaaggcccaggattcattattgtattagtctccacagagctgaacccaggctcctaagagtccgtcccttcttcctgtgtcctctgtcagccagcgccttctgcagctctgatcctttggtcattggtccttctttcctgcacctgaggctaagcctgagtcaagatgttctcaagatccttcctgtttcagctgcatgtctgatgtttacacttgcgactcagaactcacttcactgcaggcttctgacgccccttcaaatccatgcttcactctcacaatctgttttgaatgtctgtttttcctgggtaccacttctcagttgtccacacccagttgatcttcctttcccctccattattaaacatcttttaaatagctcatcactgcagtcttagtaagttcaactttccgtccagctttttatcttttctggtttcaacacctgggctcaaatcttagctctgacatttgattgataggtaaccttaaaaaagttatttaatctctctgagatggaaatttgtcatttgtaaaatgggcaaaattgcatgcatagagttctgatgatcaaaagaaaacacgtatgtaaagcccgtagcactcagtcaggcacttagaaccttgttaaaatgtaaatatccctcctacttaaaaaaaaattattttaagttttgggatacgtgtacaggatgtgcaggtttgttacataggtaaacgtgtgctctggtggtttgctgcacctatcaacccatcacctaggtattaagcccagcatgcattagctatttatcctgatgctctctccctcccccaatccctgactcttaacttttaaaaatgtctcattccttctctctagaaaagtatcgggactttcttttattcttttgcctcctttaaaggcacacaaggagttctctcctctctatagtcatgatcattgtagagacttttcagtctacgcaggcttcctttcaacacaggcttcctttcaacacaggcttttctaaagagtaattatatagcaagaaaccaggatttggtacagactacaatactcacacatgcccacatcatttggaggagggcattcatatcccaatgaaggaacatttttttaaaaactaggagtggtgatctgggactcaatgtaataggcgattgcttgtattagctgtttttttcttttttaaataaagctgatttctaacaaatatttgaaaggtatttagataatttgtagatgagcaagtgataatttttctgtgagcaagaatgactttccctgttttaaacgtgtcgcgtttcttattatattggaaagtgggagtggggagttagaagtatagaggataatagaagaaagtattatagtcaggtcgcgtttcttattatattggaaagtgggagtggggagttagaagtatagaggataatagaagaaagtattatagtcagggaagaatgggacactaccctgggtttatatcactgatcactgaggacgtaaattcacaatttcgtgtggcaggttgtattttcttgttctccctactttgtgaggagcatttgctattatacgttacaatgatacggaggaacaggtaggagaggaacaaaaaagcatttaggcaaaacagagacatttcatactacttagaacagagatgggatgatacaaattgctatgttcccaatacagttcatatctttggggaaaaaatagcgatgctccaatcttcatcccatccccctctttctctaacaagaaaaggaaaacgaggagcagtaggtaggtaggaggggagtgtatgacgtgaggaacaggcaaggacacagcatgtccaggaggagaaaaggggagcaaaaaacgtatacaagataaacaacaacaacaacaaaagagactccagcaagaggctatggttttgggctcctcacgtagaaatcaatgcatttaaaatatccagaattaaagttgaagaagaacactccatctacctcttctcaaattattttctttaccaatactacttccttttgtctttaaactgtgaaccactactctactgtgccttgttcttacaattatacacgtcagtgctgaaaggttcctgggagacatttcctgtagactaaggatagcacctgtgggcatctcggatcgatgaatcatggtggctggagcactgcattgagactggttcaggggctcagtctgttctcaatgggtagggtgatggaatccatcaatgctgggattggctaatgctgtcttccacaggtttggggtgggaggagttgtagggagagccgcccaagtggtgccatccacgctaagagactgagactctcatttacgaggaggttcagagacattaatcaatttgccaaaaggcacacagctacttagtatttttccaaatttaaatttaaatttttccaatttatctaaaacaaacaaacaaacaaaggttcagggccagggggaaaaatgaagattaagaggattaaccatcctgaaaatgaaaaatgatttgccttcaaggcatttagaactgaaaataaatcttcctgaagccttttgttagacactttatcaaaattgctaggagctctgactggctctcttgcaacagcctggaatccttctccccagtttcagaggagtttcaaaatctgtaatattatagactgactatttcttccagggggagaatttttcttagtgcttggataaagagatgaagtattaagacactttaaactattattcatgtaggattaacagatatttgaatttaacttcagaatcttttaaatgacaccccacttaatataatttttaaaaagttctttctgcagtgtatcaaataaaagtcccagatgggatttggacttggttttaactaatcatggtagcaggcagtagtctcagttctagaataaatggcactccaagtaagagacttaagttcttcatcagtgccaggctgcaacaacatgctttgagggaactctggcccctaaatgtctcctctacttgcctggaaatttactattaaacattcagaatttttttgaaaatgctaatattcttgggtgatacgccatttcaaatttattgttagctaataagtaaggaagaaggaaaagctagtgatgaggtggagtgatttgttaatagctgtgggataagagaagagagtgaccgaaataatagttttccaagagtagctacaggaggggttttgctggcccaaagatggacttcattgtctcaaaactactcctaacaccagaatgtttaactgaccttaggccttatatgtctgaggacccaataactaacactaagcagctgatgaaaaaccacccacataaataaaccctcaagatgccttcggaaaatagaaaagaaaagagaaaaacaatgtaagaaagtgtaggagtgccttctcttcaacatttctgagagaagatgggagttgaaaaccttaaacaaaatgttgccccaatctcacttgcctaattttagttatcttggttcagggctatgattcatccctaaagctgtgaattactgaggaggaaggagggaaaaaaaaatcgacttaaatgtcaaagaagtaggaacataaatatagttttcttttttgaggaactagaattccaggatatagggatcttttttctcataagggactgaatccttcaaacttctagaaaaataatgatctgcagtcaaaacatcatcaaggaatgaaagacagaattgattatgagtcatgtcatgtctgaatttttgcctctatagtgtattttcctttttttcttttgtatctctttcaatctggttaaactattaattaattaattaattttgagacagggtctctctctgttgcccaggctggggtgcaatggctcaatcatggctcactgcagccttgacttcctgggttcaaatgatcctcccacctcagcctcccgagtagctgggactacaggtgcacgccgccacacccagctaatttttgtagtttttgtagagacaaggttttgccatgttgcccaggctggtctcgaactcctgggcccaagcaatctgcccaccttggcctcccaaagtgctgggattacaggtgtaagccaccgtgccaggccaatctggttaaactagaggtcactaacaattgtatgcagttgaagatgacggaggtttaatgtgtagactgtaatgacaaagggaactcataaaataggtgagtgtgaaacgaatggaggtaagtggaactatgagaaatgattctaggggatgtgatggtagcacagggaaggaagatatgtttgaatggttgtctaaggttctcttgtgatccttttgtggatcataatcataatgattgagttttcacagtaatatatgagatgtgcttccttcaaaccttgttatgatgttggcacactatccgtcttacataaacataggaaaaaaaagttctctttcctgccaaagaacaggggacaacagaaatggtgtggggaaactccatcctaagtaaaatgttttcaatttagtaggtgttctcctgtccatttatcaccactttgaatttctgtaagtggggagggatgaaatagcagtcactaactcatacccagttcaacaacttcaccgtctgaaggagctgaccctctaccatcagcctagctgtcatctgcatgtttgcctctttctgctctgaaaacttctgagcagtaaaagaaatatatggtggtcacaaaaatacggtccaggacgttggaggagggtcatattgtgaagaaggcaaatgagaaagaaagagtttcaatgacttcagagtgatcctccacatcctgaagctatgagagtagcccagggcacaattgtgacattgatttcagcccctaccctctagccctgtcctcagtctcctcagagcactcttctcatcttcctcatggctctacatctttctgttctcctcttacctgggtattgctgtggacaagagcaattcctctatcttatcacccaagacccaaagtgtcactcagtgaatgtgaccaatgcatcttgatgacaacctaacgggatacttaggaggtggaaaggactctggaggttgccggtttaagtgactttcttgcccattgcaatccttttcttgcatcttctggaagatgttaaccctatggccatgactacctaacattgtgtctagtggagagatattttaaggtccatagaagaatttttttttcagaagggtccttggcctccctcatttcatgtcaccttggtccactgcctttcttacaaatccagttcttctaatttaattttctgagcttctgctaggcgcgccaaagtgcaatgaagacttgtttctgttttttatttccacgaatttttttttttttttaccttgtgtggcaatgttttgggtccaattctgttctccaaatagatatattgaagtcctaactcctactatcggtgaatgtgaccttatctggaaatagagtctttgtagatctaatcaagccaccaagtttgtggtagtttgttctgatgattcttgaaaagtaacacatgtagtaataaaggcaaagaggaagggcaactggaagccaaagaaagaaggaagaggtttttttcttggcttaatttactgatgcactggtattaatttttgattaaaatgatccagaattgttccacatgaacccttgaaaaataattcatgggaggccgtctctgtccggatctttaaaatacaacatactctgctatttaaataaattcccatcgcacaatagtcagctgtttttcagtgctcttgattaacaattgggtttgttttccttaactcgactgctttgattttttgttttattttgccttttaatattttatttagtaacataaatgcatgaatagtaatgttcatttcatcaaaatatggaatcaaaggcacttaaaaatacgaattatccgtaatatatttttcaggtccaaatggaattctatctatttctacattccaagactctaaagaatttactctctataaacagcatttagaatgaaatcaggtcttgcttaaaataatcaatctcagtggtttcctgcgtagcgctattctttgtttacaaacagcacaaatacagttaaggactacagtcatatgctgcacaacgacatttcagttaatgatgcatataatatggttgtcccataagattataatactgtgtttttactgtatttttctatgtttggatatatttacataaacaaatacttaccattgtgtgagagtcgcccacagcattcagtacagtaatttgctgtataggtttgcaacttaggagcaataggccactccatatagcctaagtgtgtaataggctagaccatctaagtttttgtaagtgtactctatgatgtgtgcacagtgaaatcgcttaatgatgcatttctcagaatgtagctccgtccttaaatgatgtatgactatatttatatttgcaaaacaaaacctttttaaggccttcaattgtaatacatatcgagtgcccaaatttaaaaatgtatgtcaagaaccttcacatatccaattttaaagcacggtcacactctataagcttctctaagacaatctcttctattatgttactcaattatctgaaaaattcaagagtcttaagaaaaagttcttgtgtgtacttcgtgcctgagcaaacgttcaagaattgggatacatgtatattctcattgaccagaaatttcaatccttttcagaagccattctggattcttttaaatccagaatggcttctgaaaagatgggatttcttctgcttcttagagatgaggggttcagcttatgatcaatgcagaacacatctgttgcctctctctacaaagggactggggtacggacgtcagatctaaagtcacaatcaatgtactgcactgctccacctgtaggatgtttctgccccacttactctaggagacacaccatctgagcctcggtgataatacaagcacctggactatcgcaagtgcagggttaggactactcacttgagtgtggtgagttctgtaagggatggctgagtagccttgagatagctttctctccgcgcagcaacttttggagaaggcttaggactcgtgtctgagtctccactgtcttcatcccccatggccttgatataactgccactccgcattcttcggcatggaatttcatcatctttacctcgtggggtgtaccctgtccattcatcttgtggaacctattcagatagaaaacagataaatcactttttataaaagcctacctttttcttttctttttctttttttttagatttaacatttctattttttttttttttttttgagatggggtcttgctttgtcgcccagactggagtgcagtggtgcaatcttggctcactgcaagctctgcttcctgggttcatgccgttctcctgcctcagcctcctgagtagctgggactacaggcacctgccaccacgcctggctaattatttgtattttcagtagagacggggtttcaccgtgttagccaggatggtcttaatctcctgacctcgtgatctgcccgcctcggcctcccaaagtgctgggattacaggctaacatttctaatttttatgagtacgtagtaagtgtatatatttatagagtacatgagctattttgatacaagcatacgatgtgtaataatcacatcagggtaaatggggtatccatcacctcaagcatttgtcatttctttgtgttacaaacattccaattatcgtcttagttatttaaaaatgtataaataagaccaagtattttctttttttggtatggtgctggatattggtaatataattatctgaaactttagacattaacctttcaataacaatattttattgtaataggctcataaatattttgaatatgtacaaatccacgtctctcagtctttaacatgactcatgtagtaggaaaaattaaaaccattggctttgaatcatttgtacatctcagttttctcatgctgataatagttgagtcaggcataagaatgccatttgaaaggagagcaattttatttgagcttttcagtgatttgttttcaattgccatttaagattcgggaatgtttactgattgatctatgccttccttgaacctttcgactttaccatctcatatccagtctgtcttcttcctaaaccagtggtctctaccagctgcatttactccccagtcacttattctttctgaatctttcttaatttggattcagcttccttagatctgcttaaagcactctctaaaggtttccaatgatctcctaatggaagataatggcattttcttgcttttattttttcttggcctctgcacacccgtgcacacacatacacacaaataacacctctttgcaagtttctccccttttggccttctgattgcttgacttacctggtgtagctactacttgtctgaattgttcctttccttttgctttgctggatcctactctaagtccctaactgtggataccacaacaaaatcatattgtcagtgcactgctcttcttttttctttccacagtcattttttctgagttcagcagagcactgcactacgttttagaagccatcttcatgactttctcttcagttcctcttagattttccacttcaacatgaactcaacctagatctcattccttcttcatttttcatgacgtgaaaaaaaatgcataataaccactctttttattcattaagaagtaacatagcaaacatactatagtggacagagcactgcacaaggcttaagtaaaagagaccaaaaaacggggaggctggttcttgccctcaacatatttataacagagacgagaagagaaacgagagttagcagtaatggtgatgggaaaggaggatccaggaaaggctccctggaattggccaggtttgcaatgagaaaataaaaaggcttttaatattttgatgttaactatttactgcttatccattaaaataacatggtacttcattattaacatttaactgtgctaaaaaaaaattgcctataagatctcatttcatcaatacaacaacctgtgcatatttttctgtttttctcaggtgagaagcaggaggtcagagaaggtgagtaacttgccaaaggacacacagctaaaacggcagcactagggttcgaggtgtttaactcctaagatcaaaattatattaatcaaaattttatgatttatgtcactttgaaacctaaagtgttaagaaaattgtccacaatagcacacacacatatcagacacagatttctaaatattataggttctaaggaagtgagaatagatgttctactaaaagagcataattctttcctttttaattgttaattcacctgtataactggaaagtttagatctaagaacttcagattgaagagatgctactattcatggtcttgaaaacagtggtttgtaggttctaattctgaaaagtactaaccaagatgaagcatcaccctgcagcatgttcattttatttaataaattcttatattgtgctcctgtgtgcaggcactgttctaagtgctttttaaatgtcagctcatttgatccacacagcggaggggtggtattattattattcccattttacaaatgaggacactaaagttatgtagctcactcagagttacagctaagaaggggctgagtttcaatgaggcagttcctagggccatatcttgaccactgtttaatgctccttgtctttctaggctgtgctttgtggcacctgcagaactgagcaattatagtcccggacacctttgtgctcatcacatttgatacacttgtcatttattaattatgctagtaacaatgtaatgtttttacttttgtaggtaaaagcatcaaaatcaccacagcaacaaagatttctcaggaaattataaatgctgagaacagtcttgttttccttgcattggcaggtgactcactgcatagatatgatcatcttcagagcctcattataggtttagcaattacattttaaaaattaacttggtacagctgagggtcatagatgacgcacaccacacttgctatttctcaatcctgatgtgaagttcataagcattgctctctggagtatgtcagagactaatgacaaactgattagctcatatggcttatgcaacaaaacatggcaaattttgttcagatatttttttcaaagttagtttatggtagaaatttgggctcatactagaaacagtctgtaactgttgtttagggaaccagctgagaagtatttaacctgtgtatctttcaattaatcttacttttcaaatgatagcagctaagaagttatgtggaagtgacttccattggagtggaatttgaatagtaatacattatttatatacctaaaggtagcatacaacaagattacacataaaataatacagtaatccgttctagggaaagtgtaaagacagaaaatcgagaccttggagaagaaaaacacaactgctgaactgtaagggccattaacatcgatataatcgagtcagtttttagtttttgtttcttaaaccctaaagcaaaagggagacattgcttaggtagatagttttagaagaaagcatataaagtgataagcataccaggcccaaagagtgaaatgttactgccttttgattgtaaagaaagggagaattacatggctgcagctgctattgtgagctgggcagaggttgctgtgtctttccatttcagctgcacagagagaaaagatttaggaaaatccaaagaaaaagataaccttgcagctgtctctgaaaagcctgcgttattactgtggtggcagtttcaggagctggaagtcttggtagaaggaaagctggagcagagacaaagagtgcaggtcctcattgatttcaggctggtgggatgccctgcttgtgtgcaccagcttaggagggggttggactcaacaaacataaacaaataataataaaagcaaactaatacaggttagattttatagtagttatggatgagaaaaaaggattaattgctttttaattattatgtttaagcattagcactccaacagagatcttaatttttgatgaaacaaaatgaggattagtgtgcattgtctatttcagtggtagcccgtctataactgaaaccatatgttatcattcagaaaactggaagacctgcccttgactaagaaatggccataatcaagtgctaacatcctctaattacaggatagggatgtagggatggtttttttttttttttttttttttttttttttgagacagggtcttgctctgttgcctgagctggagtgcagtggcgtgatcttagctcactgcaacctccacctcccaggttcaagcgattctcttgcctcagcttcttgagtagctagaattataggcctgtgccaccatgcccagctactttttgtattgctagtagagacaggattttgccatgttggccaggctgctcttgaacatattgaaagaactatttcaatacctttttttttttgaggtggtgtctcgctctgtcaccaagactggagtgcagtggcacgatcttagctcactgcaacccctgcctcctgggttcaagagattctcctgcctccctagtagatgggactacagatgcccgccaccatgcctggctaatttttgtatttttagtaggattggggttttgccatgttggccaggctggtctcaaactcctgacctcatgatctgcctgcctcggcctcccaaagtgctgggattacaggggtgagccaccgtgcccagccaggatgagaatgctttctgaattgaaatgatgtcactgcactgaaggatgggctctgctggaagtggagtatcttttggtgctgacatttccccccactttaggttttcctaaactcagttgaaagaggaacacacggccggacgcggtggctcatgcctgtaattccagcactttgggaggccgagacgggcagatcatgaggcaaggagttcaagtccagcctggccaacatataaaaccccgtctctactaaaaatacaaaaaattagccaggcgtgatggtgggtgcctgtaatcccagctattcaggaggctgaagcaggagaatcgcttgaacctgggaggcggaggttgcagtgagctgagatcgtgccactgcgcattttactgaatctaagatactaatgcaattgtcccaacattttttgtgtcactaagaaagaaataaacatcatcaataaattctgacactccatagaatatataatttatcccaatatccaaaatgctaaaacgtgtaaactatggctcttagaatcaattaaaaaccttttaaaaatatgtatgagaagaaaaacaagaaatgaatttattctgggatagtaattgttgaacttaatgttcatatttagtaatgaccaaattaatataagcaattacatttatcatgtcatgagtttggaaaaaaacataagttcacataatgtcttatgatccttacaactatcatgaaggatatgaagagtaaatattataacctcagtttgtcaaatagagaaactgaggtcaggagagattagtaactagtgtagggtgacactgcccaagctgaggtctgccattcacagttcaggaatctcccccgcccccttctagcatattcatatatgtcttttgacatgtcttttgggtaacaattgttattttttgataaactacaaagcacatattttagataagaaaataatatcatagtgttttaaggtctgtttgaaggaaaaaattaataaacaaatagtgggttacaaccctttgaaagaaaagttacaagaactactctatcagatgtaggaacgcttagttttaaaagtctctccccaagggcatctagcttgagtgccccactttggctgggctgcagttatcaaagtgtagctaaatagattacagtctgtgccaatgatggtctgtgagacgatgattgagagatgaagccatgtgcacgtgactctttgagagcggattatctcaggatgggaagttgcatggtgaggtgtggagtaatgagaatgcgtgagattttgggaaatctgagagccacaaaaggaatgaagacacttagaaagccgggacagctgaaatgaagcatatgtcctgaaaatatacaagggcaggcctgtgcgattctgtgagctattctgggttgcagagatttgggaggaaaactgatgaacccaaggctgtgagtacataaagcaaagttctatttcatcaggaaccaaagaactgggaggaaggaacctaggcatttggttgatttggtgaaaacaaaggcagtagagcaaggaaaagtagcaattgaatggtgggcatgagggataggcttctatttgcacagttacccctcagcagctgttgattccttcccaagcacaaggtatttcaatgacagcagccaggtaaataagggtgcttggcagtgacttagggatcaacctgtttgactttcctgtgcttgaaaaggaatggtaaataggaggagaaaaatgtacattatgaaaggagagttgggcatctgacattcatgaaaaaatctgacaattatggaataatctcaatgagctaggggcagtgcctatgttactttatgttaatctttgcagcagttgtatagaataggcattactatttccatcttactgcttcaaaattgagattcaaaaaggagagttaggcatctgacattcatgaaaaaatctgacaattatggaataatctcaatgagctaggggcagtgcctatgttactttattttaatctttgcaacagttgtatgaaataggcattactatttccatcttactgcttcaaaattgagattcaaaaaggtaaaatgcaatggctcatgcctgtaatcctagcactttgggaggccaaggcaggaggatcacttgattccaggagtttgagaccggcctaggcaacatagcaagaccccatctctacaaaataattttttaaatgtagctggtgtggtggtggtatgtgcctatagtcctagctatttgggaggctgagacaagaggattgcttgagcccaagagtttgaggctgcagtgagctatgatggtgccaccactctccagctggccgacagagtgagactctgtgtcaaaaaaaaaaaaaaaaaaaaaaaaagatgaaacgacttgcccaaggtcataataattggtagaaatgtgcatttgtctgacatcaaagcttttaataatattaccttgcctctgatgaatccgtgatgattaagtgaatgaaccaataaactaaaaaaaagaagaagagaatggggtgcacgctcccactcaacagtcgtggtttttaaaataaaatgtaaccattcaaataagcataaacgttctcgtgtcactaattttctagcactgctaaaagagggttcaaaataataaacacttaattctgaagtgaaagagtgttgttgtttcctggtctggggctgccttaccaagtattgtttgcagctgctgtttaaacaagcatgaacagtttggaggagggagtgggtgattagaaaacttgcaggacagccacacctttaagggtggcttgggagccttgaagcatcccaacagcgttttagcatttgtaagaaggctccaccctggactttaggttcctgcctacaactttttagagaaatggctgtaatgtgttggccttctaagcacttttagtgggctctcagattccctactcactcgatttctttgcatcttctttgcagctgggagaactgcttttctgctccacacagctttcaccttgacaaatgcgacttggcttaaatgtccctttagcctttttagcttgctcttctcatagcaaaaacagaaaaaaaaaaaaaaaagagcaagaataggaaaattacaattatgcaatgtgcagatccctaggcatgattgttgcttcccaatcaggagaagatttccctggcaaccgccctttcttactcccctggaagcccgaaattggtggaaaacttaatttgttttagattgcttaaaattaccttttaaggataagagtaaatacctacctctttaaatagaatttataccctttgtcacagctcttccaaataacatttttaaatgatcttgaaagaatagaacattgtaaacagtgatacatacggtaatttgcttaccatgaccctgtagaattattcttacccacaaacatttacagtatctgcagggtacccagcaccatagcaggggctgggtaaatacaccaaaagcattttataaaacacagtctctggtgttaaaggagtttataagttttgagtggatctggtgaatctggagggtggaggaaggaaacgagtaaagagcagctttaagtaagtcaagctgagtcgagtattaaatctcagtacctctgaatttcctactgggtttgaagcttgttcccataaatcccctttcctggtgatgaaactgttccttaaaaattgaacatatgtgtgtgaagtgcaaatgccactgataaatagccctgcaggggaatggcagagggcctaggtctgcagtccccaagggattggggagccatgggcctttggggactagtagaaaatgttactgaggtgctggatgacatcaaaaggggcactaactgtggataagacactctcgtgatatcacatcaagaaataataactaagatgctgggtgtggtagaatgcacctgtagtcccagctacttgggaggctgaggtgagaggatcacttgaatccaggagttcaagaccagcctgggcaacacagtgagacaagatattaagattctagtatgatgtagggacaggaagggaaatgaattttattaattattcacccactattttgacggtagtgaatacgtataggtttagctatcccagttccacttctggttcttgtagccaagcctcctgattttgctttgggaaaagctttctcctcaattcgaggtccatgtatttcaggagtagcccaagagttggggtaggacaatcagcaaatcacacttcctggcttcattgcttggctcagggcagaggtgaatgatctaagcttactcagtcagcaagcatctctggacctgtgcatgaaatgccaggacaaagatacctcctctctcactgaatatattaatagggatgcatgtgaccttaggacttgtcggtagccattttataacatctaatacacaaacataatttcacgtaatacaaaaaccttatgttatcttaatgccattgcaatgatgaaaaaattgagacttagtggtattaaataacttagaccaaatgttacagcttgtcagaattgaaagacaggtttgtcttactcaaatttctacactcttcttcacaccaggctgctgtctataagagtttcaaaactttgttatagtaattttctattaaacctaaaattcaagtgttaagttgctgagagatacaatcccatagcattttggaacttgtaacaagtactgagtgttagatgcttggcccagcactttgggaggccgaggcgggcagatcacctgaggtcaggagtttgagaccagcctggccaacatggtaaaaccctgtctatactaaaaatagaaaaattagccaggcttggtggctggcacctgtaatcccagctactcaggaggctgaggcaggagaattgcttgaacctgggaggtggaggttgcaatgagccaagatggtaccattacattccagcctgggtgacagagtgagactccctctcaaaaaaaaaaaaaaaaaaaaaaaaaaaaatagaggtctaggtctatggtaaatatattttttccactgactatataggagataagctaacttagagcccctttttagtttttaagataacttcattttctggtgtattggaggcatatctgttggcttggaattgttagttgagccatcatagctttccattattgttatagttactagtgtgctggtgtctatccaccatatcctatgatgtttgtggctataattcctagttgcaaacattgaattccctgaggcaaactagaattttgtgtctggtgttcagaagcagagatgtgggtagaagattagtgaccttcctcttgctgccaatagaagcccacatgtggaaacatcattcatcaacactaatccttggtgttgtctaaaatcacataaacctctcagcacatctgtctgttgctatacacacccaactacttgtcaaacttgtatattaattttttccttaggacacaaaatctgataatgttattattaacaaatagtatagctagagtctataaaatatcaagtcaatcatctcaagtattaatacttaattttaaaattaaaaattttaaaaaaggtttcggcaaatattttcctttagtctattatcaattttgaaatattaagtttcttaaatgaggcttacttgtgaatcattaacttacatatttgacatttataaacaaagaaaaatctcaatagatttaagaagagacacaactcagagcctcctgcttctcgtcatcatcatctgattcccactgcatcttggggctgtttggactttttattccaagctacatttataacacctgaaagcatacggcattcaaacgggccaaaataatctttccttcctgaatcccatccattctaatgcaatgaaaccgtcaaaccacatgcatctagttcttgagatcgggaaaataactgaataatattttggtgtcctcatgcacatgtgtgattcaaaattccactttcataatcatcatacagggaagttgcctcttgagggtgtgtactttaagctacgtttcaatctactttccacaggcagcaagatatctataatgaacagaggatgtcccacaaacatgtgtacagatgagtatgatacactcaatagttatccaaatcagtgcttccaggctagctcaaggtccattgaaaggaaatgttccaactggagtattcattacagggttctcttctttcactttaaactgattactttgtggttaagctggagttaaaagttccacttcttctgtgactttatcaaaatgctttagaagtattcattcacttgttcaacacatatttattgagtatatacagtcatcctatggtatctgtgggggactggttccaggataccaaaatccgtggatgcttaacttcctgatataaaatggtgtagtatttgcatataacctatgcattatcttcccatatactttaaatcatctctacattccttgtaataccaaatacaatgcctgcacatcacttcatttgtgtggattcaacatagtactcagggttcagcaaattcaagttttgttttgtgcaattttgtggattttttttccaaatatttttgacccatggttggttaaatccacagatgcagaactgatggatacatagagaggactgtatcatgaaacaggtgctattttaggtactggggataccgcaattcacaggcagagaaaaaaatctccgttcctcaaagaactaaaaatagaactaccatttgacccagcaatcatagtactgagtatatataggaaaataaagcactctaccaaaaatacacctgcactcacatgttgatcacagccctattaaactatactaaagtcatggaatcaacctaggtgctcatcaatcgtaggttggataaagaaaatgtggtacatatacactatggaatactatgcagccataaaaaaagaacaaaatcatgtcctttgcagcaacacaaatgcagctggaagccattatcctaaatgaattcatgcagaaacggaaaaccaaatactgcctgttctcacttgtaagtgggagctaaacgatgactacacacagacataaagatggcaacagtagacactgaggactccaaaagaggggatggtgaagggcaagggttgaaaaactatctactgagtactatgttcattatttggatgatgagttcaatagaagcccaaatctcagtgttatgcaatctatccacgtaacaagcctgcacatgtatgccctgaatctaaagttaaaaaataaagctctgctgtcatgaggaagggaaaggacagacactaataaaatgggcaaaatgtatgttaggcaatgatacgtactatggaaaaatgaaagcaggaaagggggaagactgtgtggaggagaggtgggtggtgggataggcatgttaatagtggcatcatcgcaggctacattaagagacctctaggtaccgactgactggagtcagggactctgccctggggtctggtggcagagtgctcaaggcacaaagaagcacagatgagaaagtcctgaagaaagggcaggactgccatgcacacagcgggaggccaggtgagtggagtggagtgagaggtggcagaaggtgaggacagtgatttggggagtgtgggggtccatttcaggaggctttacaggctgtggtaagggctgtggcatgtacttggggtgagatgggagtagaatggaggctttgatgagatacagacacattctagttcaagagaatcacgcaggttgctaagttgagaatggctcaagggcaacaagagtagaatcagagacccttggaggctcatgcaataacctagattgtagctaaaggggaggagccagggcagagcagcggtggagggagaagatagggccaagaggtttgctaacgatgatctggatgtgtggactgagaaacagtagttaagggcgactccaaggtttttgacctgatcagctggaaggactgaattcccattagctgagatgacaaggcctaaagaaggagtagactcaggatggaaattaggagttcagtttgggatgtaggaagtttgaaatgcccatgggtcatctaagcagagatgttgaatagggtagcttactatctaagactggggcttcagggtggctgcaaacatccctgtgggcatacacctgggacttagagctctgagaatgaaggaggtgacctaaggagtgagtgttggtagaagagagaaatggtccaagagccatgtccactcagcattgctccacccttagaagtttggagctaagaaaccacaaactaggcaggcttaaaacgatcaacaaagggtgtgttgtcggtcctggaagctgagtgaaaaaagtttttcaaagagaaaggagtaacgtactgtcacattgacttcttcccgtgatcttaatcccatgggacactaagtcagcaacgttaattttatctcttagtctcagttgccatagacaaaggattctgctgttcatgaatagctttatcttcccagcaagatgcaaacttcttgagagcaaggcttttgttttcttctttttctctctctctctacagcagtggcttttaaatagcttttggctacatctcacagcaagaaatacatcttactttggaaaccagtataagcacgtatacaagtgaaagacagagagaaatacttaaccttttggcatgccacacactgtctttattttcattctcttctgttgtattctatttaattaaaaataatggtgtttgtgacccattaaattgatttcactaccactaattagttgctaccattgcttagaaaagcactactgttagagtgtctgccacagtgctctgccacattcattattaatcagagagacactgttattcatcttcattccttctcaagtaccttctataaagcaagtacttaatagatgcttgccaaatgaatagttttgagaccctaaagtaatacttcttgaattgggctccttggtctttagttacctttacttttactgattgtacttctgtactgattgtagtcgtgtagaagaatatttcttaaaacctctgtgtcttcagaataaacacagacctgcatgtctttttaaagaggtccctgtgtagccaagagtcagacaaaacaccagccagggttggagatgacagcccagatgaagtgagtccatcatctgggttatcacatgtgcaaagttagggcaagaatcctgaagtttgaatgctttttcatgttcttgtacatcagcctctgggggccaggggcagtggtgttcaaaacatttttaaaaacaagacaggccaggcacagtggctcacgcctgtaatcccaacacgttgggaggctgaggcgggaggcttgcttgagcccaggtgtttgagatcagcctgggcaacagagcaagacctcatttcaacaaactatttaaatattagttgggtgtggaggcatgtgcctgtagtcctagctacttgggaggctgaggtgagaggatctcctgagcctaggagctgaaggctccagtgagttgtgatcaggccactgcactccagcctgggtgacagagcaagactctatctcaaaaaaaaaaaaaaaaaaaaaaaaggacaaaaagacaaaacaaaacctttaaaaaaaaaactttcaagaacaatcccatctttttattataatttacatagtattcaatgtcaatatgaaatattgattatttaaaaatgggagtagaaatctttcattaaatatctatgacccaaagtcgatggagctgggaaaatcattagtactaacaatgtcttagaattttgaaatgcccaactacagaaatgatatataatttaacccagacatttcatttaaagaatctttaaaataagagccaggtacatggtaaagtcctcaataaatgttagctaatgtttaaatccttctctatagagaatgcttataaaagtggcactgaagaaaataaaatatttttccaccatgtaattcttacttaggtagtttttcacttataaggaaggaggatggtgcaatgaatacagtacatcaggtcaacctgagttcaaatctgactctacttagaccagacatgtgattttggcctaattacctgaacatcttttaacttcaggttttcaaacataaagtgaggacagcaatacctacttcagagactgactataaagatagagatgatataaagtaacatatgacatgctaactcattcaaagtgtatttgtaggttgctttttcatatagtaatcatgtttaaataacggttaagttcccacatggtgcaaacccttaaagcttgtttcattcatgatagagctgacccttaatggattgtgcaatagatccaagactctctgagcttgggggtgggagggggtggagggtggggaaggttagtacacttgggggaatctctagaggcctgtgtataggggactgtggatcagtcagggttctcagaagagaacaggaaaaaaaaagatttattttagagatgactgtggtgagtagcaagtctgaaatccacagggtggtctggcaggctggaaactcaggctggagttgattctgcagtcttgagacagaatcttgtcaataaaacctcaatttttggtcataaggcctttcaactgattggttgaggcccatccacattatggagggtaatcttctttacataaagtctactgattatagattttaaccacgtgtatacaattactttactgcaacacctagattagggtttgattgggcactgggtactctaaactcagcaggtggctgcacagaactaaccatatagacaggaattcgggtgggcagcttctgaggcagtgggagggagacttgatgggcagacagggccgctgcagtgcttattgatattcagattctcttcagctgtgagctgcatatgctccgttcattttctgaggaactatggtttgggtcaaagacgtgagtgtaaagaccatctcctcactggttgttcaggagacccacaaaggccatgtaagcaaagtgagactcttactggctctgtaccagcacctagcaaggtgcctggcatgtcaatttcattgacaatgttctttaagggcaaaagagtcattcatggaatttttatttcttgttgacaaatgaacaggaaaatctacagtcacctgaaacatcccaccatggtaaataaacaggaaattggccaggcgtggtggctcacacctgtaatcccagcactttgggaggctgaggtgggcggatcacgatgtcaggagttcaagaccagcctggctaacatggtgaaaccccatctctattaaagatacaaaaaattagccgggtgtggtggcacatgcctgcaatcccagctactcgggaggctgggggcagaagaataccttgaacccgggaggcggaggttgcagggagccgagatcttgccattgcactccagcctgggaaccagggcaagactctgtctcaaaaataaataaataaacaggaaatttatagactcatcttttatttaagccctttgtattctgaaagacaaagaattccataatgcccggccttgataaaacaaatatagagctaaccttaaaaaaatcaagatttactgtagcaacttgcacatactactaatgtaacactgatcacattgttttaaaaccatttgtttatagatcagtctcacccaccaatctgtaagcaacttgagaggagggatgatgtcatttgtctggcagagaccaatattcattcctataattctagttctaagcagagtataaaagaaaacaacatattgtaaagtaaaagtgctcatgaaatctctaattacatcactcaggttgtacctattttattcaactgagaaataaagtatggacacctttcatcccagattttcctctaccaagggcagggaagaaacctcgcaatggttgtgggcaaacagggatcatggaggaacacatctccgtgcacgaagttgctggtgcatgtgtgtagagggggtatgaatgaccagtatccagaagagaggctcttttggcatccaaggagctgcagttggatgttgctgtggagatatttggggaagcaaggccacaacccccagcagggtcaactgaactctactaggcccagagagacccatcaccagatcatggcaggacgagtcaaacagaatctgaagactgtcatctcaccctgtgtattccaaagcacattttatggatcaccaatccttttttttttaatactttaagttctgtgatgcatgtgcagaacatgcaggtttgttggatcaccagtccttagaaatgttctgtgaaatgtggttccaagagggtttgggagatgctttatactgtattgttctcttaaagagtttccatccatatgagcatcttaaagattctaggatgtctgccaatatagaattctgaatacagtactcagtttctcaaattcaactccttttcttcacattaatatctattcaaatcatcctttgggaaatgtcagcttcttcacatacaaacaaagaaattgacatccagaatgtaaattacagcttatatggctaataagtggcagaactgggttagaattcagatctcctttggcccattgcactttcccagttcatcacactgcaactatttatctcaccactgaactcttcatgaatacctttcaacaaattctgtgaaactgttttgatctccctatatcaacatgtagaagacaaacatgaaggaatggctactgtgtataggagggactcagcctttggaaacttcatattttgtgtcaagcctgtgccaggatatgtttcattcaagttatcagtgcaaatgagaggtggtaatagagacatgtaagtgacatggatctatacaaataggtttgggtcacatcttgtattttacaccaagaacctagatcatgccaaccttttgatggtaaaaactgtaatgagagaagaatgcttcgtcaagataataaatgattacctttgcatatagaaataaccagaacccatgcatgcacactccattattccttctgtctcccgacattgactggaattcagtctttagtatcctctctctgtcacacacacatgaacgcacaagcacacttcatattcagtgatgatgtttttcctattacaaaaactgtgaactacccatggacagtaataatgcagatatatttcatttgagaaaggctttcttttgtcattttctttctttacctttttggtgatgagtcaagctgacctgctgggtgagatggttcagatattcatgcttcctcctagtaacgatgctggctttctgcaattcaaatgacccactacagctgcacgagtaggcacttagccacctactccagttagtaattattcgtttagactaaaaaattctgaatcaatagaaaaacattgaattaagcctcatttttgatatctcatttgacaaaggaatcatgttatttttccttgcagtggatttagataaacatccagaaaaaaaaaatgttttgtgttggaacggccacagagaaccttctttttttttttttcccaggagggaacataattctaagtcaggaaaaataatttatgtggcttcctagtttctgcccaaaccagccatatgctctcaatattactggaagaagtctgaaacagaaaatacaaagtaggggcaagaaggcccttgtgggggatgcaggggtggaaaacgggaggcagcttaggtgccccccccatcactgaggcagaggagtgagagcacctttctcctttgtacacccacttgtctgtcaactttcctccttccatttgaggctgctcctggatgtaaattttgacctgctttcagttgtaataaatacatgaggcatagaagtaagagaagctcaaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacaggcacatgccaccacgcccagttaatttttgtatttttggtagagatggggttttgccatgttgcccaggcttgtctcaaactcctgaccctcaagtgatctgcccgcctcagcctcccaaagtgctgggattacaggtgtgagccaccgcatctggactgttttgttttgatttactaaacagcttttatttttctcttctgttacacagaaacaaacaaaaagataattattttgtttgggaggcatttgggtatcatgaaatatttaaatcagagatttctagcacgtgtgatcaatgaaaatagagggaaactaggacttctgaactgatttccttttggagcattctcatagatgaatctacaaggatacaatgatttgtctgaatgataaatttacctgaataatttatctgaatgataaaattttgatacctttattaagatacttgaaggtgttggtttacaaaagattaagtaccacagtgtaaaaattctattgttgcattaatttgattagcaatgaaaaactcagaatccatttctaaagaagttgataatacaaataaaacatttacctaaagactgactatacacaaataatttctgcaatttatccaactcataaattggtatagagatttatgggccgggcgtggtggttcacacctgtgatcccagcactttgggaggccgaggcgggtggatcatgaggtcaggagatccagactatcctggctaacacggtgaaactccgtctctactaaaaatacaaaaaattagccgggtgtggtggcgggcacctgtagtcccagctactcaggaggctgaggcaggagactggcgtgaacccaggaggcggagcttgcagtgagccgagatcgcgccactgcactccagcctgggagatagagcaagactctgtctcaaaaaaaaaaaaaaaaaaaaaaaaagatttatgtaatagatgattaatcatagcactggttgtaaaagcaaaatgcatggtagtgaatactgttccccaatatgtattgctaatatactagttctttaacatgtgatgttaatatagtacaaagtagcttcattaaagaaagagttttgatttgattcaatcctgtgttcccggtgtctggaagtgagcttggcacacagtagatgagcattaaacatttgccaaatgaatggacactccatataatcaaatatatgtacataggtgaatgtgtacgtacacatatacatatttgtatgtttgactatatgtagaaaatagcagaaggcgaatgttaaaatggtaacagtgatggctgcctttggttaaataagactggaacacggtgggggagggagcttttacttttaaccctgtatcaatctgtactatttgaatttttttcacaattagcatatgtaacttttattaaaaaatgaattctgtgaaagaaccccaaatgtacgaccactggagatctgcattttagaatttgtgttgtctttacattatctcaccttaaagatacaactccattatgtacacgataacctaaggaacaggctttgactggaaattgatgaaacttggaccacagaatcagaaattagaatcttcaaagaatcgtcattacagattatattttgcttttccatttcttcagcttcaaccagaattttatattcaaagttaagaaaatttacatgtaactgtatgcaaaaacccatatggcctgtgtcagtctgtaccacttattttcaatgagataaaatagcttatttaaactttgaattttcccattgggtttagatgatttagctgtttatccagcagccctatacttaaaaatagatgagatgacatttgtgggttctttaaaaaaataccctttggagaaagaagcagaacactaatgccatatttaccatttacattatataagaatggcaagtttttatagaatgagtgcttcatagaaaatatcctcctttctggccaggcgtggtggctcacgcctgtaatcccagcactttgggaggctgagggggcagatcatgaagtcaggagatcaagaccatcctgggtaacacggtgaaaccctgtctctactaaaaacacaaaaaattagctgggcgtggtggcgcgcgactgtagttccagctacttgggaggctgaggcaggagaatcgcttgaatctgggaagtggaagttgcggtgagccaagatcgcgtcattgcactccagtgtggcaacagagcaaggctccgtctcaaaaaaaaaaaaaaaaagaaaatatcctcctttctaacataaaagctatagctcttctgtaaccagtcacaatcattgcatatatgagggcatcccacataagtttcattatttgatgattataattaatttaatggaaacataaacatggttggaaagtttccaataatagcataggaagatttttctctcccttctcccttccaattatgtagtgcctccccgccatcgccatcattcttttatcaattatttattgtgtgtctgctatgtgggaggcacagttgttataaaacaaatataaagttgatgttgactatatttaacttgaccttatatacctatttaataattatagcaacctgccaaaaatgagaagtgattaatattagccctaaacctgctgtcatacgattccacagagttcaagataagaattaacataagttaagctgaaaatatactgtcacctgaaattgcaaactgggtaggtatacaggagaacgatagtcaattaaagtatgaaatattcaaatcagtgttccaatcttggtagcattgctgatggcaaaggatgatgacaccaggaggaaatgaaagcaaacacatcactttcctactcagaatagtacacctatcttaggatcttactgattttatttattaaaaaaatacactttaggagaaaagtgcatttatcgggtaatatgaaagaggaaatgaggtctgtgtgagggcatgggtatatgccatcactatgcaacattttaatcttcagtttttataggagtttcctctgagcactcatcaaaggtaatgggattagattttttttcttcctttgtcaaatgttttcctcaccctgaatactgtcacacacgtcgcaggtggatgagatttgtccactgaggaggaattgcacttttcgaccctcctaggatgtgacttgaatacctggcttgttccatgttgggcttgccacctgctcctgctctgaggtagccgctgacctaaaggcatcgcaagggtggtgaggtgaagagggagcaagtgttctcagccacacatttttccatctcccctcagaatccacctctcagaggtagcctaagtggccctcctaccggatgcgttgttttatcacgactgcagctttcttttcttagattctgccaatgcttttaatgggctggtcccctgcgaagagcagggattttgtgttttcttttgaagagcgtggtagatttctgagcaccctgtggcagtctgtaaaagtgataaatacaaatgatgaacaatgaagcaggctcttgagttctggggctggctacaggagaactcagaacgagggaaaaaaataaatcaatttctaacacaaaggcaagatttagcctctcattagatccaactgctacatgtaaagaagtttgttaagaaaatggcacagggattttgtgaggtggagccaagcctgcgaaataggctttcaagatgtgttttctatcttccttccaattttgggtgctatgatgtaacaggattttgaaatccaagcatatgttattttctttcttcttttccttttatgtttaaacctccattatgatgaattagctttccttcctcaataatttagagtttattttctataaaaaggaagcatttagaaatgtgatattaggcatatggccccctttcagatccttccagttctatttgtatatggttttagactcagctgtaaatatattaatttatgcagcaatggatattataaatcctacactttatatagatgtaggctctttcttttcataaacaaaacttgaaacaatactaaatttttaaaaagatagacataattgataatttcactttgagaaagcaaagtaacccagattgtaaatgttatggacaaaggctgggcgcagtggctcatgcctgtaattctagcacttcgggaggccgaggttggtagattgcctgagctcgggagtttgagaccagcctgggcaacatggtgaaaccccgtctctactaaaaatacaaaaaaaattagctgggcgtggtggtgtgtgcctgtaaagccagctatttggggggctaaggcacgagaattgcttgaacctgggagacggaggttgcagtgagccaagatcaagccactgcactccagcctgggcgacagagtgagattctgtcaaaaaaaaaaaaaaaaaaaaaaaaaaaaaaaagtcagggacaaggataaatgcaaattgtacacatttctctctcttgattttatgatagtttggaaaagaaccattttttaaaaaccagtatattactaatggatggcatctaatgtcttagtaattaaaaaaaatatagattgggatggagccacagaattcaacaatggggagaagagagaaatagaaggcagagacaattttagaataatagtcaactgtctgtggaaaaaggggagcttcagttagtgaatgaaagaattgagttttcctgatgttttcatctaagattaccctcataccacatgcacagggcttgatcataaagtatttgaagttagtaaaaatgtaactagtccagttgagctaaggaaatatcaaaatgtcaattgttctttcccaagtttagtcaagctaatcagattctttcagttgttaagaaatattctgttgtatggtttatgtgtaaatatgactagaaattctcagcagtggtaaagcatcgtaactgggcatggttgctacacatatttgtatctctgatagtgcctggcattgtcccttgcatacacaaaaagttcaaaactacatgcttaaaagtgaaggatttcactctcccctgaaagcactctatttgatagagagcagcactcttttgtgcttacagcaatgagtaaactcttagagccaggttgtgaactgcttgttgtggatatatgctgtagacatttaatcacttgataactcattagtgatatatttaattcatctaagatgatttatgtttcaaatgtgaacatgatgctttaccattacttttactatttaataaaaagataattgttgcatccatttataaattttgcattaaacatgacacatttatcttttcaaagaaaataattgttaatcttagaaaattttcctcaaatgtgcaatacaccaggcaaaaaccaaactctggttttactgtacttgaaaataaattagcatgcatttcacatggtattttgttattctcctttcatagcctgctttggttaaaaaaaaatcatgtcataaaagagatggcaaattagatctgggagtgaagaaaacttgttcctaaattttatcttagatattgaactactaaatagatgataatgaaattaatgtctatttcatgcatgaagcagctctattacgtgcttttataatttcttgcttttgagaggttaaggtggaagggcttattttctttagacactgatcctgggattcatgaacttcattattctctttatcttatgataactatgcccacagggtacaattaatgaattaattcatcaatccactcattcacatttatcgaatgcttcctgtgtgccaagcactgtgcgagtagaaaccacaagaatcaataaaatcaatagacttatatttgtctctagggggtctactgtctattgggggacaggtagaattattggaggggagggagcaacaagccctcaaacttggtgtcagcaaagtgtgaaaatcactagaaaatccacacgtaggcattggtagcatgggagctagtttaaggaggttatacttgtcttgggacttgagtgatgggaaagactttggcaactgggcaaagagaagagaggagggcagtacagaagtgggaacagaaacatgagcacataaacaggcactatatatactcatgggaagcagcaagcttcacttcggacctagggcctctcagggtactgctagaaacagattctgttgaaggtattcagcttgtgctaatagtctgtacttgttttaaagacccaggaggtctttttcagaatgtattttcttgaacagcctctttctatcaccaacatggcactgagaacaatagaaaacagctccttttgtttctgggacacacctcctcttttctaagattcatgcctggttgcccagggaaattcctcaaaccagcctttattctgagctgatcactctcttctgaacaggacattccgccatctgctcagacaccctggctgtcagccccaccctgaatcaccaggcatcacctcccttctcaaggagacctcacttctctttatgtctaaagccccacaaatggctttactccttcaaaaccctctctttctagacttcctctagcgccagcgttgcaattcctctgaccacgtatttaggcacacatataatatttagagggcctctctactccacatttaaccctgtaatatcatcttttttatattaacatcttattcctctttatcagctcatttggagccatgtttcatttcccaaaatatcaccactatattcttttggctgttgcatcaaattaccataaacccagtggcttaaaaaatctcatatttaatctcttacagttgtggaggccagaagtccaaaatagtttcactgagctgaaaccaagatagcagagctgggcgtcctctggaggctcgaggggagaatccatttccctgccttttccccttgtcccatggtccctttctccatcttcacaaccaagagcaaagcatcttcaaatctctctccgcttccacggccacatagtctccctctgcttccttcttaaaagaacacttgtgattacatttagagcccacccagataatccaagacaatctcccaccttaagatccttaatgtaatcacatctgcaaagtcatcttttccacataaggtaacatcctcagtttcctgagattagagtgtggccccatctggagcctctattccactaactacgaccacccacactaacaccattgttaatcgagtacttactctgtgccaggcattattttatgataggcaccatcattatctccattttacagatgaagcagttgaggcacagaaagctttagtaatttagtaaagtcatatagacagagaagtggtagaaagagcattcaaatctaggtctgttcaactggaaagctgtcactcattcacggaacaccctgttgcctctcacattttccagctgactgtgtgcgtctgtgttctggtttgaattaaaggaacctaaaaactctcatggtcaacacaaaatggaaaatttcccagaaactgcacatgtctcttctctagctgtacttgtagatatttcttccacaaagagcatagctaattaactggttaagtggtaacaagtagcagtttgcttccccagtgaaataccagtggaagcccccctaagtagtctgacatcaggctacggttgaagaacatgaagggccaactgagttcaggcaaagtgctatggaaacagtaatcacagagcaggtccaggaaaataatgcctgtttaaaaggacaatggaaatgaaacagaaatgtaaggcccagctactttctctgtagagaaagtgagaaaggctgaaaactcctgtagacataaggcttgaagaagaaagcttgagaataaagaatacagcacaaagggaagtactttcagtttaatttaagggaaaaatacactcagggctgactattggagatcagaaggcaaatgaacactggcaggcagtgagaaattaaggatttaaaaaatgatccttatacatttttaagaataaactttttcttttattctaaggaggcagtaaatcacgtggaaaatagaaagaactggtccctggagtcaaacagactgagggtcccattccttaatatcagcatcatacatgacaacttgagcctcagttctttcatttacaaaatgggaacaacaacacgaagattaaggaaattatatgaaccaccttagcacagtactttgcaggaatgagtagcataaaaaatcattgcatctggtttctgcaacctcagcaagacaaaaggtaatacagcttgttaaagagtccagctagctactagtgcattcagagagaattcactctgtgccaggcatggtgctggatcacgggccacaactatgaataagagaccagctatgttctttcatgaaacgatctagtggaagagtcaaacaagaaaacaggcaatcctacctaagatagaagaagcatgataaggaaatgatgggtgctatgagagcatattgggagaggatacctcacttaaacttggccagtcagagaaggcttccaggaggaaacattatcttagatgagactggaaagttgggaagaggttaagtagggaagagaggagtttggcaggggtggggggtgaggggtggagggggttgtaggcaggcagaagagacaaaggaggaagcagctcatgcaaaggtcctgggcaagagaacatggcactgctaagaaagagaaaagcagaccagtatggctgaaatgcagagtggacagagggagtgttaggaaatgagattgtgaaggaaaaaggtccccagctacatcatactctctaagtcatgtttaaaagtttggactttatcccaagggtaaagaggaaccagtgaaggatttttaagcagaagatttaatgattttatctgtattttagaaagatcatttgggctataatgtgcaggatgaactggatttaggagaaactagaggcaggaagaccactaggagatatttacaatagtctagctgagaaatgatggaggtttaactgggatcgtggcaaaaggaatggcgagaagtggacagaaataagatttggtgtttttttttttttccactcattcattcattcaactaacttttatgagtctgccttagaggagagacacgagggtgagatagagagaggtatcaagattggccccatgtttcagcgttaaaaaaaagcatagatagtggtgccatttacaggggtaggaaacatggggtagcaggctcttgggaagatactgagtgcagtttttgacatgataggtttttgtgtcatgcctttatttttgtaacctcgatatctttgtgtaccccaacctgtgagaatagatgaggtcatattaacagtaataaccaagtccagtgatactttagttctctctcatctttgttcctcgcccagttaattctgattgtccacaaggatgagcttcacgtgtatttgggaacaaatctgtttgctgccttctgtcaggcctttttgcaatggtgccaagaacttcttatgactgtgggccatctgtactgatgctgctgcctcagtcaccactgtcctcagctggtacctgctctgtggcctttgatgtgtgtgtgtatatagggaaggtgggggtgcttctttctctagatattctctattaattaactaacacagagctaatatgtgagtttgtaaataacacatgccttgcatttggcattgctaaaaataccttcaagggctaacaactttgcatcttatctcccagcatgcatgggttgaccactacagacaaaagatcatgaagctgatgctggccaaagagccttgcacattttcaccctcaagttggttttatgtagcaattgcggataaaaagctctgctggtataaaaatcttcttattgtacaaatggcaggaaatagaagacaacattgcggtggttacaaaaatttgtttcctagtttgtttctgccagctttaaattgaacatagatcaatctataggttctgaattagtaatattggggagacatgaaatgagaaaaatagcagaattaaataagcataacagtgcacggggcagcccagcatgctctggagcgatgaggggtgagagagaaaggaagaaaagaagaaaacaaaatgaacacctttcaaatccaaaacaatgcaccacgtttgagcctccaatatagttttacaaagacagaatagccatgaaatcaaacatttaagtataaataggtaacatatgtctgtcttattgttgttaaaaattaactgtgatagactgaaattccattccacattcctacttcttgatgacttagtaaattacaggcatttcaagagaaatgcctaaaaattttaggtgaaccatcgacgatattttgggtggaagtaagttatatgtggtagctaaatacttgtgctcaagctctcagcatcctgtttatacttctaggaaagacatatgaaatgtgaacaatttcaaggaatgaaataaatgttcttctttatctataaaagtctgattgtggtgtttaaaggcttccatgaaacaaaaacacctgtgcccacagctcgtctcccgtgcataaaaacagaatacaaagatgagacagtaggaataggaggaacattttctatttctccaatatttcccacatgctttggctgtttttgaatagaccttctgaaatatcttttgaggtcacctactttgtgaacctaaagtctctgatttttcaggtgacatggcagcaagcccgaatgtctgaaaacataaatcttagttataatttccatttttgtcattttgctagaaaagaaaaatatgataatttcttccccagcttgctaagcctttgctagtttcaggaatttctgctaccatctgatgaaaatcaaaatccccgtattaaacaccaaaaagctatatcacaaaaaagtgaagccatcctagtaagtgcctcatcacttcttgtttttgagatagagtaaccaaggtagcaatagaagtctcagagagagctgatggtttctaattccataaacttagtggacaagtacattttccacatgaaccaaaatcattgccgccatggtgaatcaaaaaagtaataacaaaaattcacattaccagcacgctgttattttaaaaatccaattttacaaaataaaactcacctaaactgaagctgtggaataattttagcaattgaaaattactaccttctctagaataacatgtacttagaaatgaaatgattcagaaatcaacatgatgtacgtattctgcttttctttgcagcttagagcaaattcaacatcaatttacactatatcatagtaaatatattcaacaatcagtgcttaagtaatttagcctgtctttgctgcatctaaatattctgctgtttaactaaattcactccatactatagatgataaaaatattaatatacacatttcattcttattaaaaagctggatttctcccttagccctgcaagtaccataagcaaccaaatcagaggaaaagggtatgttggggctactctttataaaattgttcatccccagttcacagacatcatgaaacatgaaattaactccagtatgttaaaagaaagatgatagattagcacagaaatcaagcacaaagaaacgatttattttcctttccatagcccagaattgctattagcttaccttattagctggaatgccaaacagaatgtctttatggaaaattaagttcattattcatctcagctttgatttggtatagtgcagctgagagcatttagcttctctctatgatttgccgattctaagt
